US009382540B2

(12) United States Patent
Prakash et al.

(10) Patent No.: US 9,382,540 B2
(45) Date of Patent: Jul. 5, 2016

(54) COMPOSITIONS AND METHODS FOR MODULATING ANGIOPOIETIN-LIKE 3 EXPRESSION

(71) Applicant: Isis Pharmaceuticals, Inc., Carlsbad, CA (US)

(72) Inventors: Thazha P. Prakash, Carlsbad, CA (US); Punit P. Seth, Carlsbad, CA (US); Eric E. Swayze, Encinitas, CA (US); Susan M. Freier, San Diego, CA (US); Mark J. Graham, San Clemente, CA (US); Rosanne M. Crooke, Carlsbad, CA (US)

(73) Assignee: Isis Pharmaceuticals, Inc, Carlsbad, CA (US)

( * ) Notice: Subject to any disclaimer, the term of this patent is extended or adjusted under 35 U.S.C. 154(b) by 0 days.

(21) Appl. No.: 14/701,999

(22) Filed: May 1, 2015

(65) Prior Publication Data

US 2015/0315594 A1  Nov. 5, 2015

Related U.S. Application Data

(60) Provisional application No. 61/987,467, filed on May 1, 2014, provisional application No. 62/049,230, filed on Sep. 11, 2014.

(51) Int. Cl.
*C07H 21/02* (2006.01)
*C07H 21/04* (2006.01)
*C12N 15/113* (2010.01)

(52) U.S. Cl.
CPC ............ *C12N 15/1136* (2013.01); *C07H 21/02* (2013.01); *C07H 21/04* (2013.01); *C12N 2310/11* (2013.01); *C12N 2310/315* (2013.01); *C12N 2310/321* (2013.01); *C12N 2310/3341* (2013.01); *C12N 2310/351* (2013.01)

(58) Field of Classification Search
None
See application file for complete search history.

(56) References Cited

U.S. PATENT DOCUMENTS

| 3,687,808 | A | 8/1972 | Merigan et al. |
| 4,469,863 | A | 9/1984 | Ts'o et al. |
| 4,751,219 | A | 6/1988 | Kempen |
| 4,845,205 | A | 7/1989 | Huynh Dinh et al. |
| 4,981,957 | A | 1/1991 | Lebleu et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,134,066 | A | 7/1992 | Rogers et al. |
| 5,166,315 | A | 11/1992 | Summerton et al. |
| 5,175,273 | A | 12/1992 | Bischofberger et al. |
| 5,177,198 | A | 1/1993 | Spielvogel et al. |
| 5,185,444 | A | 2/1993 | Summerton et al. |
| 5,223,618 | A | 6/1993 | Cook et al. |
| 5,256,775 | A | 10/1993 | Froehler |
| 5,264,562 | A | 11/1993 | Matteucci |
| 5,264,564 | A | 11/1993 | Matteucci |
| 5,319,080 | A | 6/1994 | Leumann |
| 5,359,044 | A | 10/1994 | Cook et al. |
| 5,366,878 | A | 11/1994 | Pederson et al. |
| 5,367,066 | A | 11/1994 | Urdea et al. |
| 5,378,825 | A | 1/1995 | Cook et al. |
| 5,386,023 | A | 1/1995 | Sanghvi et al. |
| 5,393,878 | A | 2/1995 | Leumann |
| 5,432,272 | A | 7/1995 | Benner |
| 5,434,257 | A | 7/1995 | Matteucci et al. |
| 5,446,137 | A | 8/1995 | Maag et al. |
| 5,457,187 | A | 10/1995 | Gmelner et al. |
| 5,459,255 | A | 10/1995 | Cook et al. |
| 5,466,786 | A | 11/1995 | Buhr et al. |
| 5,476,925 | A | 12/1995 | Letsinger et al. |
| 5,484,908 | A | 1/1996 | Froehler et al. |
| 5,489,677 | A | 2/1996 | Sanghvi et al. |
| 5,502,177 | A | 3/1996 | Matteucci et al. |
| 5,508,270 | A | 4/1996 | Baxter et al. |
| 5,514,785 | A | 5/1996 | Van Ness et al. |
| 5,519,134 | A | 5/1996 | Acevedo et al. |
| 5,525,711 | A | 6/1996 | Hawkins et al. |
| 5,552,540 | A | 9/1996 | Haralambidis |
| 5,567,811 | A | 10/1996 | Mistura et al. |
| 5,576,427 | A | 11/1996 | Cook et al. |
| 5,587,469 | A | 12/1996 | Cook et al. |
| 5,591,722 | A | 1/1997 | Montgomery et al. |
| 5,594,121 | A | 1/1997 | Froehler et al. |

(Continued)

FOREIGN PATENT DOCUMENTS

| CA | 2450022 | 12/2002 |
| WO | WO 94/02499 | 2/1994 |

(Continued)

OTHER PUBLICATIONS

Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.

Allshire, "Molecular biology. RNAi and heterochromatin—a hushed-up affair" Science (2002) 297(5588):1818-1819.

Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nuclewsodies Nucleotides. (1997) 16:917-926.

(Continued)

*Primary Examiner* — Traviss C McIntosh, III
(74) *Attorney, Agent, or Firm* — Ionis Patent Department

(57) ABSTRACT

Provided herein are methods, compounds, and compositions for reducing expression of an ANGPTL3 mRNA and protein in an animal. Also provided herein are methods, compounds, and compositions for reducing lipids and/or glucose in an animal. Such methods, compounds, and compositions are useful to treat, prevent, delay, or ameliorate any one or more of cardiovascular disease and/or metabolic disease, or a symptom thereof, in an individual in need thereof.

28 Claims, No Drawings

(56) References Cited

U.S. PATENT DOCUMENTS

| | | | |
|---|---|---|---|
| 5,596,091 A | 1/1997 | Switzer | |
| 5,597,909 A | 1/1997 | Urdea et al. | |
| 5,602,240 A | 2/1997 | De Mesmaeker et al. | |
| 5,610,289 A | 3/1997 | Cook et al. | |
| 5,610,300 A | 3/1997 | Altmann et al. | |
| 5,614,617 A | 3/1997 | Cook et al. | |
| 5,625,050 A | 4/1997 | Beaton et al. | |
| 5,627,053 A | 5/1997 | Usman et al. | |
| 5,639,873 A | 6/1997 | Barascut et al. | |
| 5,645,985 A | 7/1997 | Froehler et al. | |
| 5,646,265 A | 7/1997 | McGee | |
| 5,670,633 A | 9/1997 | Cook et al. | |
| 5,681,941 A | 10/1997 | Cook et al. | |
| 5,698,685 A | 12/1997 | Summerton et al. | |
| 5,700,920 A | 12/1997 | Altmann et al. | |
| 5,750,692 A | 5/1998 | Cook et al. | |
| 5,763,588 A | 6/1998 | Matteucci et al. | |
| 5,792,847 A | 8/1998 | Buhr et al. | |
| 5,801,154 A | 9/1998 | Baracchini et al. | |
| 5,830,653 A | 11/1998 | Froehler et al. | |
| 5,994,517 A | 11/1999 | Ts et al. | |
| 5,998,203 A | 12/1999 | Matulic-Adamic | |
| 6,005,096 A | 12/1999 | Matteucci et al. | |
| 6,268,490 B1 | 7/2001 | Imanishi et al. | |
| 6,300,319 B1 | 10/2001 | Manoharan | |
| 6,383,812 B1 | 5/2002 | Chen et al. | |
| 6,525,031 B2 | 2/2003 | Manoharan | |
| 6,525,191 B1 | 2/2003 | Ramasamy | |
| 6,582,908 B2 | 6/2003 | Fodor et al. | |
| 6,600,032 B1 | 7/2003 | Manoharan et al. | |
| 6,620,916 B1 | 9/2003 | Takahara et al. | |
| 6,660,720 B2 | 12/2003 | Manoharan | |
| 6,670,461 B1 | 12/2003 | Wengel et al. | |
| 6,770,748 B2 | 8/2004 | Imanishi et al. | |
| 6,794,499 B2 | 9/2004 | Wengel et al. | |
| 6,906,182 B2 | 6/2005 | Ts et al. | |
| 6,908,903 B1 | 6/2005 | Theodore et al. | |
| 7,034,133 B2 | 4/2006 | Wengel et al. | |
| 7,053,207 B2 | 5/2006 | Wengel | |
| 7,259,150 B2 | 8/2007 | Crooke et al. | |
| 7,262,177 B2 * | 8/2007 | Ts'O | A61K 47/48276 514/19.3 |
| 7,267,819 B2 | 9/2007 | Ferrara et al. | |
| 7,399,845 B2 | 7/2008 | Seth et al. | |
| 7,427,672 B2 | 9/2008 | Imanishi et al. | |
| 7,439,043 B2 | 10/2008 | DeFrees et al. | |
| 7,491,805 B2 | 2/2009 | Vargeese et al. | |
| 7,569,686 B1 | 8/2009 | Bhat et al. | |
| 7,582,744 B2 | 9/2009 | Manoharan et al. | |
| 7,598,227 B2 | 10/2009 | Crooke et al. | |
| 7,723,509 B2 | 5/2010 | Manoharan et al. | |
| 7,741,457 B2 | 6/2010 | Swayze et al. | |
| 7,851,615 B2 | 12/2010 | Manoharan et al. | |
| 7,935,796 B2 | 5/2011 | Lee et al. | |
| 8,106,022 B2 * | 1/2012 | Manoharan | A61K 47/48092 514/25 |
| 8,137,695 B2 | 3/2012 | Rozema et al. | |
| 8,158,601 B2 | 4/2012 | Chen et al. | |
| 8,313,772 B2 | 11/2012 | Rozema et al. | |
| 8,344,125 B2 | 1/2013 | Manoharan et al. | |
| 8,349,308 B2 | 1/2013 | Yurkovetskiy et al. | |
| 8,404,862 B2 | 3/2013 | Manoharan et al. | |
| 8,435,491 B2 | 5/2013 | Wang et al. | |
| 8,450,467 B2 | 5/2013 | Manoharan et al. | |
| 8,501,805 B2 | 8/2013 | Seth et al. | |
| 8,501,930 B2 | 8/2013 | Rozema et al. | |
| 8,530,640 B2 | 9/2013 | Seth et al. | |
| 8,541,376 B2 | 9/2013 | Ferrara et al. | |
| 8,541,548 B2 | 9/2013 | Rozema | |
| 8,546,556 B2 | 10/2013 | Seth et al. | |
| 8,552,163 B2 | 10/2013 | Lee et al. | |
| 8,653,047 B2 | 2/2014 | Crooke et al. | |
| 8,673,632 B2 | 3/2014 | Crooke et al. | |
| 8,742,075 B2 | 6/2014 | Lee et al. | |
| 9,127,276 B2 | 9/2015 | Prakash et al. | |
| 9,163,239 B2 | 10/2015 | Prakash et al. | |
| 9,181,550 B2 | 11/2015 | Prakash et al. | |
| 2001/0053519 A1 | 12/2001 | Fodor et al. | |
| 2003/0017488 A1 | 1/2003 | Koishi et al. | |
| 2003/0077829 A1 | 4/2003 | Maclachlan | |
| 2003/0119724 A1 | 6/2003 | Ts et al. | |
| 2003/0170249 A1 | 9/2003 | Hakomori et al. | |
| 2003/0228597 A1 | 12/2003 | Cowsert et al. | |
| 2004/0171570 A1 | 9/2004 | Allerson et al. | |
| 2004/0242516 A1 | 12/2004 | Crooke et al. | |
| 2005/0009088 A1 | 1/2005 | Crooke et al. | |
| 2005/0130923 A1 | 6/2005 | Bhat et al. | |
| 2005/0164235 A1 | 7/2005 | Manoharan et al. | |
| 2005/0255487 A1 | 11/2005 | Khvorova et al. | |
| 2006/0148740 A1 | 7/2006 | Platenburg | |
| 2006/0183886 A1 | 8/2006 | Tso et al. | |
| 2007/0031844 A1 | 2/2007 | Khvorova et al. | |
| 2007/0054856 A1 | 3/2007 | Gerber et al. | |
| 2007/0287831 A1 | 12/2007 | Seth et al. | |
| 2008/0039618 A1 | 2/2008 | Allerson et al. | |
| 2008/0108801 A1 | 5/2008 | Manoharan et al. | |
| 2008/0113351 A1 | 5/2008 | Nalto et al. | |
| 2008/0177045 A1 | 7/2008 | Lee et al. | |
| 2008/0206869 A1 | 8/2008 | Smith et al. | |
| 2008/0255030 A1 | 10/2008 | Yu et al. | |
| 2008/0281041 A1 | 11/2008 | Rozema et al. | |
| 2008/0281044 A1 | 11/2008 | Monahan et al. | |
| 2009/0012281 A1 | 1/2009 | Swayze et al. | |
| 2009/0203132 A1 | 8/2009 | Swayze et al. | |
| 2009/0203135 A1 | 8/2009 | Forst et al. | |
| 2009/0286973 A1 | 11/2009 | Manoharan et al. | |
| 2009/0306180 A1 | 12/2009 | Bhanot et al. | |
| 2009/0318536 A1 | 12/2009 | Freier et al. | |
| 2009/0326040 A1 | 12/2009 | Geary et al. | |
| 2010/0240730 A1 | 9/2010 | Beigelman et al. | |
| 2010/0331390 A1 | 12/2010 | Crooke et al. | |
| 2011/0039910 A1 | 2/2011 | Crooke et al. | |
| 2011/0077386 A1 | 3/2011 | Lee et al. | |
| 2011/0097264 A1 | 4/2011 | Wang et al. | |
| 2011/0097265 A1 | 4/2011 | Wang et al. | |
| 2011/0123520 A1 | 5/2011 | Manoharan et al. | |
| 2011/0201798 A1 | 8/2011 | Manoharan et al. | |
| 2011/0207799 A1 | 8/2011 | Rozema et al. | |
| 2011/0243948 A1 | 10/2011 | Lee et al. | |
| 2011/0269814 A1 | 11/2011 | Manoharan et al. | |
| 2012/0035115 A1 | 2/2012 | Manoharan et al. | |
| 2012/0095075 A1 | 4/2012 | Manoharan et al. | |
| 2012/0101148 A1 | 4/2012 | Aking et al. | |
| 2012/0122958 A1 | 5/2012 | Dawson et al. | |
| 2012/0128760 A1 | 5/2012 | Manoharan et al. | |
| 2012/0136042 A1 | 5/2012 | Manoharan et al. | |
| 2012/0157509 A1 | 6/2012 | Hadwiger et al. | |
| 2012/0165393 A1 | 6/2012 | Rozema et al. | |
| 2012/0183602 A1 | 7/2012 | Chen et al. | |
| 2012/0230938 A1 | 9/2012 | Rozema et al. | |
| 2013/0004427 A1 | 1/2013 | El-Sayed et al. | |
| 2013/0023579 A1 | 1/2013 | Crooke et al. | |
| 2013/0109817 A1 | 5/2013 | Yurkovetskiy et al. | |
| 2013/0121954 A1 | 5/2013 | Wakefield et al. | |
| 2013/0178512 A1 | 7/2013 | Manoharan et al. | |
| 2013/0236968 A1 | 9/2013 | Manoharan et al. | |
| 2013/0317085 A1 | 11/2013 | Crooke et al. | |
| 2014/0343123 A1 * | 11/2014 | Prakash | C12N 15/113 514/44 A |
| 2015/0057329 A1 | 2/2015 | Bhanot et al. | |

FOREIGN PATENT DOCUMENTS

| | | |
|---|---|---|
| WO | WO 94/17093 | 8/1994 |
| WO | WO 97/20563 | 6/1997 |
| WO | WO 97/46098 | 12/1997 |
| WO | WO 98/13381 | 4/1998 |
| WO | WO 98/39352 | 9/1998 |
| WO | WO 99/14226 | 3/1999 |
| WO | WO 00/14048 | 3/2000 |
| WO | WO 00/63364 | 10/2000 |
| WO | WO 01/05825 | 1/2001 |
| WO | WO 01/49687 | 7/2001 |
| WO | WO 02/43771 | 6/2002 |

(56) References Cited

FOREIGN PATENT DOCUMENTS

| | | |
|---|---|---|
| WO | WO 03/004602 | 1/2003 |
| WO | WO 03/044172 | 5/2003 |
| WO | WO 2004/024757 | 3/2004 |
| WO | WO 2004/035765 | 4/2004 |
| WO | WO 2004/044181 | 5/2004 |
| WO | WO 2004/063208 | 7/2004 |
| WO | WO 2004/093783 | 11/2004 |
| WO | WO 2004/101619 | 11/2004 |
| WO | WO 2004/106356 | 12/2004 |
| WO | WO 2005/000201 | 1/2005 |
| WO | WO 2005/021570 | 3/2005 |
| WO | WO 2005/097155 | 10/2005 |
| WO | WO 2005/121371 | 12/2005 |
| WO | WO 2006/031461 | 3/2006 |
| WO | WO 2006/047842 | 5/2006 |
| WO | WO 2007/035759 | 3/2007 |
| WO | WO 2007/090071 | 8/2007 |
| WO | WO 2007/134181 | 11/2007 |
| WO | WO 2008/073300 | 6/2008 |
| WO | WO 2008/098788 | 8/2008 |
| WO | WO 2008/101157 | 8/2008 |
| WO | WO 2008/150729 | 12/2008 |
| WO | WO 2008/154401 | 12/2008 |
| WO | WO 2009/003009 | 12/2008 |
| WO | WO 2009/006478 | 1/2009 |
| WO | WO 2009/073809 | 6/2009 |
| WO | WO 2009/082607 | 6/2009 |
| WO | WO 2009/126933 | 10/2009 |
| WO | WO 2009/134487 | 11/2009 |
| WO | WO 2009/143369 | 11/2009 |
| WO | WO 2010/036696 | 4/2010 |
| WO | WO 2010/036698 | 4/2010 |
| WO | WO 2010/048549 | 4/2010 |
| WO | WO 2010/048585 | 4/2010 |
| WO | WO 2010/054406 | 5/2010 |
| WO | WO 2010/077578 | 7/2010 |
| WO | WO 2010/083615 | 7/2010 |
| WO | WO 2010/088537 | 8/2010 |
| WO | WO 2010/101951 | 9/2010 |
| WO | WO 2010/103204 | 9/2010 |
| WO | WO 2010/129709 | 11/2010 |
| WO | WO 2010/144740 | 12/2010 |
| WO | WO 2010/148013 | 12/2010 |
| WO | WO 2011/005860 | 1/2011 |
| WO | WO 2011/005861 | 1/2011 |
| WO | WO 2011/038356 | 3/2011 |
| WO | WO 2011/085271 | 7/2011 |
| WO | WO 2011/100131 | 8/2011 |
| WO | WO 2011/115818 | 9/2011 |
| WO | WO 2011/120053 | 9/2011 |
| WO | WO 2011/133871 | 10/2011 |
| WO | WO 2011/139702 | 11/2011 |
| WO | WO 2011/163121 | 12/2011 |
| WO | WO 2012/037254 | 3/2012 |
| WO | WO 2012/068187 | 5/2012 |
| WO | WO 2012/083046 | 6/2012 |
| WO | WO 2012/083185 | 6/2012 |
| WO | WO 2012/089352 | 7/2012 |
| WO | WO 2012/089602 | 7/2012 |
| WO | WO 2012/135736 | 10/2012 |
| WO | WO 2012/145674 | 10/2012 |
| WO | WO 2012/145697 | 10/2012 |
| WO | WO 2012/149495 | 11/2012 |
| WO | WO 2012/177784 | 12/2012 |
| WO | WO 2012/177947 | 12/2012 |
| WO | WO 2013/033230 | 3/2013 |
| WO | WO 2013/075035 | 5/2013 |
| WO | WO 2013/119979 | 8/2013 |
| WO | WO 2013/142571 | 9/2013 |
| WO | WO 2013/165816 | 11/2013 |
| WO | WO 2013/166121 | 11/2013 |
| WO | WO 2013/173789 | 11/2013 |
| WO | WO 2013/177468 | 11/2013 |
| WO | WO 2014/076195 | 5/2014 |
| WO | WO 2014/076196 | 5/2014 |
| WO | WO 2014/118267 | 8/2014 |
| WO | WO 2014/118272 | 8/2014 |
| WO | WO 2014/179620 | 11/2014 |
| WO | WO 2014/179625 | 11/2014 |
| WO | WO 2014/179626 | 11/2014 |
| WO | WO 2014/179627 | 11/2014 |
| WO | WO 2014/179629 | 11/2014 |
| WO | WO 2014/207232 | 12/2014 |

OTHER PUBLICATIONS

Altmann et al., "Second Generation of Antisense Oligonucleotides: From Nuclease Resistance to Biological Efficacy in Animals" Chimia. (1996) 50(4):168-176.

Altmann et al., "Second-generation antisense oligonucleotides: structure—activity relationships and the design of improved signal-transduction inhibitors" Biochem. Soc. Trans. (1996) 24:630-637.

Ando et al, "A decreased expression of angiopoietin-like 3 is protective against atherosclerosis in apoE-deficient mice" J Lipid Res. (2003) 44(6):1216-23.

Angelakopoulou et al., "Comparative analysis of genome-wide association studies signals for lipids, diabetes, and coronary heart disease: Cardiovascular Biomarker Genetics Collaboration" Eur Heart J. (2012) 33(3):393-407.

Atsma et al., "Partial characterization of low density lipoprotein preparations isolated from fresh and frozen plasma after radiolabeling by seven different methods" J. Lipid Res. (1991) 32(1):173-181.

Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272:11994-12000.

Biessen et al., "Novel hepatotrophic prodrugs of the antiviral nucleoside 9-(2-phosphonylmethoxyethyl)adenine with improved pharmacokinetics and antiviral activity" FASEB. J. (2000) 14(12):1784-1792.

Biessen et al., "Synthesis of Cluster Galactosides with High Affinity for the Hepatic Asialoglycoprotein Receptor" J. Med. Chem. (1995) 38:1538-1546.

Biessen et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852.

Bligh et al., "A rapid method of total lipid extraction and purification" Can. J. Biochem. Physiol. (1959) 37(8):911-917.

Braasch et al., "Novel antisense and peptide nucleic acid strategies for controlling gene expression" Biochemistry (2002) 41(14):4503-4510.

Branch et al., "A good antisense molecule is hard to find," TIBS (1998) 23:45-50.

Browning et al., "Molecular mediators of hepatic steatosis and liver injury" J. Clin. Invest. (2004) 114(2):147-152.

Camenisch et al., "ANGPTL3 stimulates endothelial cell adhesion and migration via integrin alpha vbeta 3 and induces blood vessel formation in vivo." J. Biol. Chem. (2002) 277(19):17281-17290.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Conklin et al., "Identification of a mammalian angiopoietin-related protein expressed specifically in liver." Genomics (1999) 62(3):477-482.

Connolly et al., "Binding and endocytosis of cluster glycosides by rabbit hepatocytes. Evidence for a short-circuit pathway that does not lead to degradation" J. Biol. Chem. (1982) 257(2):939-945.

Crooke et al., "Basic Principles of Antisense Therapeutics" Antisense Research and Application (1998) Chapter 1:1-50.

Duff et al., "Intrabody tissue-specific delivery of antisense conjugates in animals: ligand-linker-antisense oligomer conjugates" Methods Enzymol. (2000) 313:297-321.

Dupouy et al., "Watson-Crick base-pairing properties of nucleic acid analogues with stereocontrolled alpha and beta torsion angles (alpha,beta-D-CNAs)." Angew. Chem. Int. Ed. Engl. (2006) 45(22):3623-3627.

(56) References Cited

OTHER PUBLICATIONS

EMBL Accession No. BG400407, *Homo sapiens* cDNA clone, Mar. 17, 2001, retrieved from the Internet, Apr. 3, 2013 <http://www.ebi.ac.uk/Tools/dbfetch/emblfetch?id=BG400407&Submit=Go>.
European Search Report for application EP 11732249.5 dated Aug. 7, 2014.
Expert Panel on Detection, Evaluation, and Treatment of High Blood Cholesterol in Adults. "Executive Summary of the Third Report of the National Cholesterol Education Program (NCEP) Expert Panel on Detection, Evaluation, and Treatment of High Blood Cholesterol in Adults (Adult Treatment Panel III)" JAMA. (2001) 285(18):2486-2497.
Freier et al., "The ups and downs of nucleic acid duplex stability: structure-stability studies on chemically-modified DNA:RNA duplexes" Nucleic Acids Research (1997) 25(22):4429-4443.
Frieden et al., "Expanding the design horizon of antisense oligonucleotides with alpha-L-LNA" Nucleic Acids Research (2003) 31(21):6365-6372.
Fujimoto et al., "Angptl3-null mice show low plasma lipid concentrations by enhanced lipoprotein lipase activity" Exp. Anim (2006) 55(1):27-34.
Gao et al., "Angiopoietin-like protein 3 regulates the motility and permeability of podocytes by altering nephrin expression in vitro" Biochemical and Biophysical Research Communications (2010) 399: 31-36.
Gautschi et al. "Activity of a Novel bc1-2/bc1-xL-Bispecific Antisense Oligonucleotide Against Tumors of Diverse Histologic Origins" J. Natl. Cancer Inst. (2001) 93:463-471.
Geary et al., "A nonradioisotope biomedical assay for intact oligonucleotide and its chain-shortened metabolites used for determination of exposure and elimination half-life of antisense drugs in tissue" Anal. Biochem. (1999) 274(2):241-248.
GenBank Accession No. NM_014495.1. *Homo sapiens* angiopoietin-like 3 (ANGPTL3) mRNA, retrieved from the Internet on Apr. 18, 2013, downloaded from http://www.ncbi.nlm.nih.gov/nuccore/NM_014495.1.
Graham et al., "Antisense oligonucleotide inhibition of apolipoprotein C-III reduces plasma triglycerides in rodents, nonhuman primates, and humans" Circ. Res. (2013) 112(11):1479-1490.
Gu et al., "Base pairing properties of D- and L-cyclohexene nucleic acids (CeNA)" Oligonucleotides (2003) 13(6):479-489.
Gu et al., "Enzymatic resolution and base pairing properties of D- and L-cyclohexenyl nucleic acids (CeNA)" Nucleosides Nucleotides Nucleic Acids (2005) 24(5-7):993-998.
Gu et al., "Synthesis of enantiomeric-pure cyclohexenyl nucleoside building blocks for oligonucleotide synthesis" Tetrahedron (2004) 60(9):2111-2123.
Guzaev et al., "A conformationally preorganized universal solid support for efficient oligonucleotide synthesis" J. Am. Chem. Soc. (2003) 125(9):2380-2381.
Hall et al., "Establishment and maintenance of a heterochromatin domain" Science (2002) 297(5590):2232-2237.
Hanessian et al., "Synthesis of chemically and functionally diverse scaffolds from pentaerythritol" Canadian Journal of Chemistry (1996) 74(9):1731-1737.
Hatsuda et al., "Association between Plasma Angiopoietin-Like Protein 3 and Arterial Wall Thickness in Healthy Subjects" J Vasc Res (2007) 44:61-66.
Hooper et al., "Recent developments in the genetics of LDL deficiency" Curr Opin Lipidol (2013) 24(2):111-115.
Horn et al., "Chemical synthesis and characterization of branched oligodeoxyribonucleotides (bDNA) for use as signal amplifiers in nucleic acid quantification assays" Nucleic Acids Res. (1997) 25(23):4842-4849.
Horvath et al., "Stereoselective synthesis of (—)-ara-cyclohexenyl-adenine" Tetrahedron Letters (2007) 48:3621-3623.
Ichimura et al., "Serum Angiopoietin-like Protein 3 Levels: Possible Correlation with Progressive Skin Sclerosis, Digital Ulcers and Pulmonary Vascular Involvement in Patients with Systemic Sclerosis" Acta Derma Venereol (2013) 1-6.
Inaba et al., "Angiopoietin-like protein 3 mediates hypertriglyceridemia induced by the liver X receptor." J. Biol. Chem. (2003) 278(24):21344-21351.
International Search Report for application PCT/US11/20606 dated Jun. 27, 2011.
Inukai et al., "ANGPTL3 is increased in both insulin-deficient and -resistant diabetic states." Biochem. Biophys. Res. Commun. (2004) 317(4):1075-1079.
Ishibashi et al., "Hypercholesterolemia in low density lipoprotein receptor knockout mice and its reversal by adenovirus-mediated gene delivery." J. Clin. Invest. (1993) 92(2):883-893.
Jayaprakash et al., "Non-nucleoside building blocks for copper-assisted and copper-free click chemistry for the efficient synthesis of RNA conjugates" Org. Lett. (2010) 12(23):5410-5413.
Jenuwein, "Molecular biology. An RNA-guided pathway for the epigenome" Science (2002) 297(5590):2215-2218.
Jiang et al., "The Design and Synthesis of Highly Branched and Spherically Symmetric Fluorinated Oils and Amphiles" Tetrahedron (2007) 63(19):3982-3988.
Jin et al., "Use of alpha-N,N-bis[carboxymethyl]lysine-modified peroxidase in immunoassays" Anal. Biochem. (1995) 229(1):54-60.
Jones et al., "RNA quantitation by fluorescence-based solution assay: RiboGreen reagent characterization" Anal. Biochem. (1998) 265(2):368-374.
Kaplan et al., "Regulation of the angiopoietin-like protein 3 gene by LXR" J. Lipid Res. (2003) 44(1):136-143.
Kato et al., "N-acetylgalactosamine incorporation into a peptide containing consecutive threonine residues by UDP-N-acetyl-D-galactosaminide:polypeptide N-acetylgalactosaminyltransferases" Glycobiology (2001) 11(10):821-829.
Khorev et al., "Trivalent, Gal/GalNAc-containing ligands designed for the asialoglycoprotein receptor" Bioorg. Med. Chem. (2008) 16(9):5216-5231.
Kim et al. "Oligomeric glycopeptidomimetics bearing the cancer related TN-antigen" Tetrahedron Lett. (1997) 38:3487-3490.
Kim et al., "Synthesis of Novel Phosphoramidite Building Blocks from Pentaerythritol" Synlett (2003) 12:1838-1840.
Koishi et al., "Angptl3 regulates lipid metabolism in mice" Nat. Genet. (2002) 30(2):151-157.
Kornilova et al., "Development of a fluorescence polarization binding assay for asialoglycoprotein receptor" Anal. Biochem. (2012) 425(1):43-46.
Korstanje et al., "Locating Ath8, a locus for murine atherosclerosis susceptibility and testing several of its candidate genes in mice and humans" Atherosclerosis (2004) 177:443-450.
Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.
Koster et al., "Transgenic angiopoietin-like (angptl)4 overexpression and targeted disruption of angptl4 and angptl3: regulation of triglyceride metabolism" Endocrinology (2005) 146(11):4943-50.
Kumar et al., "The first analogues of LNA (locked nucleic acids): phosphorothioate-LNA and 2'-thio-LNA" Bioorg Med Chem Lett. (1998) 8:2219-2222.
Lee et al., "Facile synthesis of a high-affinity ligand for mammalian hepatic lectin containing three terminal N-acetylgalactosamine residues" Bioconjug. Chem. (1997) 8(5):762-765.
Lee et al., "Identification of a New Functional Domain in Angiopoietin-like 3 (ANGPTL3) and Angiopoietin-like 4 (ANGPTL4) Involved in Binding and Inhibition of Lipoprotein Lipase (LPL)" Journal of Biological Chemistry (2009) 284(20): 13735-13745.
Lee et al., "New and more efficient multivalent glyco-ligands for asialoglycoprotein receptor of mammalian hepatocytes" Bioorganic & Medicinal Chemistry (2011) 19:2494-2500.
Lee et al., "New synthetic cluster ligands for galactose/N-acetylgalactosamine-specific lectin of mammalian liver" Biochemistry (1984) 23(18):4255-4261.
Lee et al., "Preparation of cluster glycosides of N-acetylgalactosamine that have subnanomolar binding constants towards the mammalian hepatic Gal/GalNAc-specific receptor" Glycoconjugate J. (1987) 4:317-328.

(56) References Cited

OTHER PUBLICATIONS

Lee et al., "Protein microarrays to study carbohydrate-recognition events" Bioorg. Med. Chem. Lett. (2006) 16(19):5132-5135.

Lee et al., "Synthesis of multivalent neoglycoconjugates of MUC1 by the conjugation of carbohydrate-centered, triazole-linked glycoclusters to MUC1 peptides using click chemistry" J. Org. Chem. (2012) 77(17):7564-7571.

Lee et al., "Synthesis of peptide-based trivalent scaffold for preparation of cluster glycosides" Methods Enzymol. (2003)362:38-43.

Lee et al., "Synthesis of some cluster glycosides suitable for attachment to proteins or solid matrices" Carbohydr. Res. (1978) 67:509-514.

Leeds et al., "Quantitation of phosphorothioate oligonucleotides in human plasma" Anal. Biochem. (1996) 235(1):36-43.

Leumann et al., "DNA Analogues: From Supramolecular Principles to Biological Properties" Bioorganic & Medicinal Chemistry (2002) 10:841-854.

Lichtenstein et al., "Modulation of plasma TG lipolysis by Angiopoietin-like proteins and GPIHBP1" Biochimica and Biophysica Acta (2010) 1801(4): 415-420.

Linton et al., "Transgenic mice expressing high plasma concentrations of human apolipoprotein B100 and lipoprotein(a)." J. Clin. Invest. (1993) 92: 3029-3037.

Machida et al., "Bivalent inhibitors for disrupting protein surface-substrate interactions and for dual inhibition of protein prenyltransferases" J. Am. Chem. Soc. (2011) 133(4):958-963.

Maher et al., "Comparative hybrid arrest by tandem antisense oligodeoxyribonucleotides or oligodeoxyribonucleoside methylphosphonates in a cell-free system" Nuc. Acid. Res. (1988) 16(8):3341-3358.

Maier et al., "Synthesis of Antisense Oligonucleotides Conjugated to a Multivalent Carbohydrate Cluster for Cellular Targeting," Bioconjugate Chemistry (2003) 14: 18-29.

Maierhofer et al., "Probing multivalent carbohydrate-lectin interactions by an enzyme-linked lectin assay employing covalently immobilized carbohydrates" Bioorg. Med. Chem. (2007) 15(24):7661-7776.

Manoharan. "Oligonucleotide conjugates as potential antisense drugs with improved uptake, biodistribution, targeted delivery, and mechanism of action" Antisense Nucleic Acid Drug Dev. (2002) 12(2):103-128.

Martin, "New acces to 2'-O-alkylated ribonucleosides and properties of 2'-O-alkylated oligoribonucleotides" Helv. Chim. Acta. (1995) 78:486-504.

Martin-Campos et al., "Identification of a novel mutation in the ANGPTL3 gene in two families diagnosed of familial hypobetalipoproteinemia without APOB mutation" Clin. Chim. Acta. (2012) 413(5-6):552-555.

Merwin et al., "Targeted delivery of DNA using YEE(GalNAcAH)3, a synthetic glycopeptide ligand for the asialoglycoprotein receptor" Bioconjug. Chem. (1994) 5(6):612-620.

Minicocci et al., "Clinical characteristics and plasma lipids in subjects with familial combined hypolipidemia: a pooled analysis" J. Lipid Res. (2013) 54(12):3481-3490.

Minicocci et al., "Mutations in the ANGPTL3 gene and familial combined hypolipidemia: a clinical and biochemical characterization" J. Clin. Endocrinol. Metab. (2012) 97(7):E1266-E1275.

Musunuru et al., "Exome sequencing, ANGPTL3 mutations, and familial combined hypolipidemia" N Engl J Med (2010) 363(23):2220-7.

Musunuru et al., "Exome sequencing, ANGPTL3 mutations, and familial combined hypolipidemia" N. Engl. J. Med. (2010) 363(23):2220-2227.

Naoumova et al., "A new drug target for treatment of dyslipidaemia associated with type 2 diabetes and the metabolic syndrome?" Lancet (2002) 359(9325):2215-6.

Nauwelaerts et al., "Cyclohexenyl nucleic acids: conformationally flexible oligonucleotides" Nucleic Acids Res. (2005) 33(8):2452-2463.

Nauwelaerts et al., "Structural characterization and biological evaluation of small interfering RNAs containing cyclohexenyl nucleosides" J. Am. Chem. Soc. (2007) 129(30):9340-9348.

New England Biolabs 1998/99 Catalog (cover page and pp. 121 and 284).

Noto et al., "Prevalence of ANGPTL3 and APOB gene mutations in subjects with combined hypolipidemia" Arterioscler. Thromb. Vasc. Biol. (2012) 32(3):805-809.

Pal-Bhadra et al., "Heterochromatic silencing and HP1 localization in *Drosophila* are dependent on the RNAi machinery" Science (2004) 303(5658):669-672.

Park et al., "The asialoglycoprotein receptor clears glycoconjugates terminating with sialic acid alpha 2,6GalNAc" PNAS. (2005) 102(47):17125-17129.

Pavia et al., "Synthetic TN glycopeptide related to human glycophorin AM. High-field proton and carbon-13 nuclear magnetic resonance study" Int. J. Pept. Protein Res. (1983) 22(5):539-548.

Pisciotta et al., "Characterization of three kindreds with familial combined hypolipidemia caused by loss-of-function mutations of ANGPTL3" Circ. Cardiovasc. Genet. (2012) 5(1):42-50.

Pujol et al., "A sulfur tripod glycoconjugate that releases a high-affinity copper chelator in hepatocytes" Angew. Chem. Int. Ed. Engl. (2012) 51(30):7445-7448.

Rajur et al., "Covalent protein-oligonucleotide conjugates for efficient delivery of antisense molecules" Bioconjug. Chem. (1997) 8(6):935-950.

Rensen et al., "Design and synthesis of novel N-acetylgalactosamine-terminated glycolipids for targeting of lipoproteins to the hepatic asialoglycoprotein receptor" J. Med. Chem. (2004) 47(23):5798-5808.

Rensen et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584.

Rensen et al., "Stimulation of liver-directed cholesterol flux in mice by novel N-acetylgalactosamine-terminated glycolipids with high affinity for the asialoglycoprotein receptor" Arterioscler. Thromb. Vasc. Biol. (2006) 26(1):169-175.

Reynolds et al., "Rational siRNA design for RNA interference" Nature Biotechnology (2004) 22(3):326-330.

Robeyns et al., "Oligonucleotides with cyclohexene-nucleoside building blocks: crystallization and preliminary X-ray studies of a left-handed sequence GTGTACAC" Acta. Crystallogr. Sect. F. Struct. Biol. Cryst. Commun. (2005) 61(Pt 6):585-586.

Robeyns et al., "Structure of the fully modified left-handed cyclohexene nucleic acid sequence GTGTACAC" J. Am. Chem. Soc. (2008) 130(6):1979-1984.

Romeo et al., "Rare loss-of-function mutations in ANGPTL family members contribute to plasma triglyceride levels in humans" J. Clin. Invest. (2009) 119(1):70-79.

Rouchaud et al., "A New and Efficient Synthesis of Derivatives of Octahydro-4H-pyrrolo[1,2-c]pyrido[1',2'-a]imidazole" Eur. J. Org. Chem. (2011) 12:2346-2353.

Sanan et al., "Low density lipoprotein receptor-negative mice expressing human apolipoprotein B-100 develop complex atherosclerotic lesions on a chow diet: No accentuation by apolipoprotein(a)" PNAS (1998) 95:4544-4549.

Sanghvi et al., "Heterocyclic Base Modifications in Nucleic Acids and Their Applications in Antisense Oligonucleotides" Antisense Research and Applications (1993) pp. 273-288.

Sato et al., "Glycoinsulins: dendritic sialyloligosaccharide-displaying insulins showing a prolonged blood-sugar-lowering activity" J. Am. Chem. Soc. (2004) 126(43):14013-14022.

Seth et al., "Design, synthesis and evaluation of constrained methoxyethyl (cMOE) and constrained ethyl (cEt) nucleoside analogs" Nucleic Acids Symp. Ser. (Oxf). (2008) (52):553-554.

Seth et al., "Synthesis and biophysical characterization of R 6'-Me-α-L-LNA modified oligonucleotides" Bioorg. Med. Chem. Lett. (2011) 21(4):1122-1125.

Seth et al., "Synthesis and biophysical evaluation of 2',4'-constrained 2'O-methoxyethyl and 2',4'-constrained 2'O-ethyl nucleic acid analogues" J. Org. Chem. (2010) 75(5):1569-1581.

(56) References Cited

OTHER PUBLICATIONS

Shchepinov et al., "Oligonucleotide dendrimers: stable nano-structures" Nucleic Acids Res. (1999) 27(15):3035-3041.
Shchepinov et al., "Oligonucleotide dendrimers: synthesis and use as polylabelled DNA probes" Nucleic Acids Res. (1997) 25(22):4447-4454.
Shimamura et al., Biochem. Biophys. Res. Commun. (2003) 301:604-609.
Shimamura et al., "Angiopoietin-like protein3 regulates plasma HDL cholesterol through suppression of endothelial lipase" Arterioscler Thromb Vasc Biol. (2007) 27(2):366-72.
Shimamura et al., "Leptin and insulin down-regulate angiopoietin-like protein 3, a plasma triglyceride-increasing factor" Biochem Biophys Res Commun. (2004) 322(3):1080-5.
Shimizugawa et al., "ANGPTL3 decreases very low density lipoprotein triglyceride clearance by inhibition of lipoprotein lipase" J. Biol. Chem. (2002) 277:33742-33748.
Sindelka et al., "Association of obesity, diabetes, serum lipids and blood pressure regulates insulin action" Physiol. Res. (2002) 51(1):85-91.
Singh et al., "Synthesis of 2'-amino-LNA: A novel conformationally restricted high-affinity oligonucleotide analogue with a handle" J. Org. Chem. (1998) 63: 10035-10039.
Sliedregt et al., "Design and Synthesis of Novel Amphiphilic Dendritic Galactosides for Selective Targeting of Liposomes to the Hepatic Asialoglycoprotein Receptor" J. Med. Chem. (1999) 42:609-618.
Smith et al., "Comparison of biosequences" Adv. Appl. Math. (1981) 2(4):482-489.
Sonnenburg et al., "GPIHBP1 stabilizes lipoprotein lipase and prevents its inhibition by angiopoietin-like 3 and angiopoietin-like 4" The Journal of Lipid Research (2009) 50(12): 2421-2429.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 12(26):8362-8379.
Tober et al., "Self-Metathesis of Polyol Allyl Ethers towards Carbohydrate-Based Oligohydroxy Derivatives" Eur. J. Org. Chem. (2013) 3:566-477.
Tomiya et al., "Liver-targeting of primaquine-(poly-γ-glutamic acid) and its degradation in rat hepatocytes" Bioorg. Med. Chem. (2013) 21(17):5275-5281.
Toyokuni et al., "Synthetic vaccines: I. Synthesis of multivalent Tn antigen cluster-lysyllysine conjugates" Tetrahedron Lett. (1990) 31:2673-2676.
Valdivielso et al., "Association of moderate and severe hypertriglyceridemia with obesity, diabetes mellitus and vascular disease in the Spanish working population: results of the ICARIA study" Atherosclerosis (2009) 207(2):573-578.
Valentijn et al., "Solid-phase synthesis of lysine-based cluster galactosides with high affinity for the Asialoglycoprotein Receptor" Tetrahedron (1997) 53(2): 759-770.
Van Rossenberg et al., "Stable polyplexes based on arginine-containing oligopeptides for in vivo gene delivery" Gene Ther. (2004) 11(5):457-464.
Verbeure et al., "RNase H mediated cleavage of RNA by cyclohexene nucleic acid (CeNA)" Nucleic Acids Res. (2001) 29(24):4941-4947.
Verdel et al., "RNAi-mediated targeting of heterochromatin by the RITS complex" Science (2004) 303(5668):672-676.
Volpe et al., "Regulation of heterochromatic silencing and histone H3 lysine-9 methylation by RNAi" Science (2002) 297(5588):1833:1837.
Wang et al., "A straightforward stereoselective synthesis of D- and L-5-hydroxy-4-hydroxymethyl-2-cyclohexenylguanine" J. Org. Chem. (2001) 66(25):8478-8482.
Wang et al., "Cyclohexene nucleic acids (CeNA) form stable duplexes with RNA and induce RNase H activity" Nucleosides Nucleotides Nucleic Acids (2001) 20(4-7):785-788.
Wang et al., "Cyclohexene Nucleic Acids (CeNA): Serum Stable Oligonucleotides that Activate RNase H and Increase Duplex Stability with Complementary RNA" J. Am. Chem. Soc. (2000) 122(36):8595-8602.
Wang et al., "Stereocontrolled synthesis of ara-type cyclohexenyl nucleosides" J. Org. Chem. (2003) 68(11):4499-4505.
Weber et al., "Design and synthesis of P2-P1'-linked macrocyclic human renin inhibitors" J. Med. Chem. (1991) 34(9):2692-2701.
Westerlind et al., "Ligands of the asialoglycoprotein receptor for targeted gene delivery, part 1: Synthesis of and binding studies with biotinylated cluster glycosides containing N-acetylgalactosamine" Glycoconj. J. (2004) 21(5):227-241.
Willer et al., "Newly identified loci that influence lipid concentrations and risk of coronary artery disease" Nat. Genet. (2008) 40(2):161-169.
Woolf et al. "Specificity of antisense oligonucleotides in vivo" PNAS (1992) 89:7305-7309.
Yu et al., "Effects of ANGPTL3 antisense oligodeoxynucleotides transfection on the cell growths and invasion of human hepatocellular carcinoma cells" Hepatogastroenterology (2011) 58(110-111):1742-6.
Zhang et al., "PowerBLAST: A New Network BLAST Application for Interactive or Automated Sequence Analysis and Annotation" Genome Res. (1997) 7:649-656.
Zhang et al., "Spontaneous atherosclerosis in aged lipoprotein lipase-deficient mice with severe hypertriglyceridemia on a normal chow diet" Circ. Res. (2008) 102(2):250-256.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.
Akinc et al., "Targeted Delivery of RNAi Therapeutics with Endogenous and Exogenous Ligand-Based Mechanisms" Molecular Therapy (2010) 18(7): 1357-1364.
Andre et al., "Determination of modulation of ligand properties of synthetic complex-type biantennary N-glycans by introduction of bisecting GlcNAc in silico, in vitro and in vivo" Eur. J. Biochem. (2004) 271: 118-134.
Asseline et al., "Modification of the 5' Terminus of Oligodeoxyribonucleotides for Conjugation with Ligands" in Current Protocols in Nucleic Acid Chemistry, 2001, Supplement 5, Chapter 4: Unit 4.9 (4.9.1-4.9.28); John Wiley & Sons.
Beaucage et al., "The functionalization of oligonucleotides via phosphoramidate derivatives" Tetrahedron (1993) 49(10): 1925-1963.
Braasch et al., "Locked nucleic acid (LNA): fine-tuning the recognition of DNA and RNA" Chem. Biol. (2001) 8:1-7.
Branda et al., "Amplification of antibody production by phosphorothioate oligodeoxynucleotides" J Lab Clin Med. (1996) 128(3): 329-338.
Coltart et al., "Principles of Mucin Architecture: Structural Studies on Synthetic Glycopeptides Bearing Clustered Mono-, Di-, Tri-, and Hexasaccharide Glycodomains" J. Am. Chem. Soc. (2002) 124: 9833-9844.
Crooke et al., "Pharmacokinetic Properties of Several Novel Oligonucleotide Analogs in mice" J. Pharmacol. Exp. Ther. (1996) 277(2):923-937.
Crooke et al., "Pharmacological Properties of 2'-O-Methoxyethyl Modified Oligonucleotides" in Antisense a Drug Technology, Chapter 10, pp. 273-303, Crooke, S.T., ed., 2008.
Crooke et al., "Toxicologic Properties of 2-O-Methoxyethyl Chimeric Antisense Inhibitors in Animals and Man" in Antisense a Drug Technology, Chapter 12, pp. 342-351, Crooke, S.T., ed., 2008.
Czech et al. "RNAi-based therapeutic strategies for metabolic disease" Nature Reviews Endocrinology (2011) 7: 473-484.
Davidson et al., "Apolipoprotein B: mRNA Editing, Lipoprotein Assembly, and Presecretory Degradation" Annu. Rev. Nutr. (2000) 20: 169-193.
Dellinger et al., "Solid-Phase Chemical Synthesis of Phosphonoacetate and Thiophosphonoacetate Oligodeoxynucleotides" J. Am. Chem. Soc. (2003) 125: 940-950.
Elayadi et al., "Application of PNA and LNA oligomers to chemotherapy" Curr. Opinion Invens. Drugs (2001) 2:558-561.

(56) References Cited

OTHER PUBLICATIONS

Englisch et al., "Chemically Modified Oligonucleotides as Probes and Inhibitors" Agnew Chem. Int. Ed. Engl. (1991) 30:613-629.
Geary et al., "Pharmacokinetic Properties of 2'-O-(2-Methoxyethyl)-Modified Oligonucleotide Analogs in Rats" The Journal of Pharmacology and Experimental Therapeutics (2001) 296:890-897.
Hoffman et al., "'Brain-type' N-glycosylation of asialo-transferrin from human cerebrospinal fluid" FEBS Letters (1995) 359: 164-168.
Kanasty et al., "Delivery Materials for siRNA Therapeutics" Nature Materials (2013) 12: 967-977.
Kassim et al., "Gene therapy for dyslipidemia: a review of gene replacement and gene inhibition strategies" Clinical Lipidology (2010) 5(6): 793-809.
Koller et al., "Mechanisms of single-stranded phosphorothioate modified antisense oligonucleotide accumulation in hepatocytes." Nucleic Acids Res. (2011) 39(11): 4795-4807.
Kroschwitz, "Polynucleotides" Concise Encyclopedia of Polymer Science and Engineering (1990) John Wiley & Sons, NY pp. 858-859.
Lazaris-Karatzas et al., "Malignant transformation by a eukaryotic initiation factor subunit that binds to mRNA 5' cap" Nature (1990) 345: 544-547.
Lee et al., "Antisense Technology: An Emerging Platform for Cardiovascular Disease Therapeutics" J of Cardiovasc Trans Res (2013) 6: 969-980.
Letsinger et al., "Cholesteryl-conjugated oligonucleotides: Synthesis, properties, and activity as inhibitors of replication of human immunodeficiency virus in cell culture" PNAS (1989) 86:6553-6556.
Link, "Pharmacological regulation of hepatic glucose production" Curr Opin Investig Drugs (2003) 4 421-429.
Makino et al., "Intravenous Injection with Antisense Oligodeoxynucleotides Against Angiotensinogen Decreases Blood Pressure in Spontaneously Hypertensive RatS" Hypertension (1998) 31: 1166-1170.
Manoharan et al., "Chemical Modifications to Improve Uptake and Bioavailability of Antisense Oligonucleotides" Ann. N.Y. Acad. Sci. (1992) 660: 306-309.
Manoharan et al., "Cholic Acid-Oligonucleotide Conjugates for Antisense Applications" Bioorg. Med. Chem. Lett. (1994) 4:1053-1060.
Manoharan et al., "Introduction of a Lipophilic Thioether Tether in the Minor Groove of Nucleic Acids for Antisense Applications" Bioorg. Med. Chem. Lett. (1993) 3(12):2765-2770.
Manoharan et al., "Lipidic Nucleic Acids" Tetrahedron Lett. (1995) 36(21):3651-3654.
Manoharan et al., "N-(2-Cyanoethoxycarbonyloxy)succinimide: A New Reagent for Protection of Amino Groups in Oligonucleotides" J. Org. Chem. (1999) 64: 6468-6472.
Manoharan et al., "Oligonucleotide Conjugates: Alteration of the Pharmacokinetic Properties of Antisense Agents" Nucleosides & Nucleotides (1995) 14(3-5):969-973.
Marcaurelle et al., "Synthesis of Oxime-Linked Mucin Mimics Containing the Tumor-Related TN and Sialyl TN Antigens" Organic Letters (2001) 3(23): 3691-3694.
Mishra et al., "Improved leishmanicidal effect of phosphorotioate antisense oligonucleotides by LDL-mediated delivery" Biochim. Biophys. Acta (1995) 1264:229-237.
Miura et al., "Fluorometric determination of total mRNA with oligo(dT) immobilized on microtiter plates" Clin. Chem. (1996) 42:1758-1764.
Oberhauser et al., "Effective incorporation of 2'-O-methyl-oligoribonucleotides into liposomes and enhanced cell association through modifications with thiocholesterol" Nucl. Acids Res. (1992) 20(3):533-538.
Orum et al., "Locked nucleic acids: A promising molecular family for gene-function analysis and antisense drug development" Curr. Opinion Mol. Ther. (2001) 3:239-243.
Petrova et al., "Carrier-free cellular uptake and the gene-silencing activity of the lipophilic siRNAs is strongly affected by the length of the linker between siRNA and lipophilic group" Nucleic Acids Research (2012) 40(5): 2330-2344.
Rossenberg et al., "Stable polyplexes based on arginine-containing oligopeptides for in vivo gene delivery" Gene Therapy (2004) 11: 457-464.
Sanghvi, Chapter 15, Antisense Research and Applications, Crooke and Lebleu ed., CRC Press (1993).
Shea et al., "Synthesis, hybridization properties and antiviral activity of lipid-oligodeoxynucleotide conjugates" Nucl. Acids Res. (1990) 18(13):3777-3783.
Singh et al., "LNA (locked nucleic acids): synthesis and high-affinity nucleic acid recognition" Chem. Commun. (1998) 455-456.
Sofia et al., "Discovery of a beta-d-2'-deoxy-2'-alpha-fluoro-2'-beta-C-methyluridine Nucleotide Prodrug (PSA-7977) For the Treatment of Hepatitis C virus" J. Med. Chem. (2010) 53(19): 7202-7218.
Svinarchuk et al., "Inhibition of HIV proliferation in MT-4 cells by antisense oligonucleotide conjugated to lipophilic groups" Biochimie (1993) 75:49-54.
Wahlestedt et al., "Potent and nontoxic antisense oligonucleotide containing locked nucleic acids" Proc. Natl. Acad. Sci. USA (2000) 97: 5633-5638.
Wu et al., "A New N-Acetylgalactosamine Containing Peptide as a Targeting Vehicle for Mammalian Hepatocytes Via Asialoglycoprotein Receptor Endocytosis" Current Drug Delivery (2004) 1: 119-127.
Zhao et al., "Synthesis and preliminary biochemical studies with 5'-deoxy-5'-methylidyne phosphonate linked thymidine oligonucleotides" Tetrahedron Letters (1996) 37(35): 6239-6242.
Zhou et al., "Proteolytic processing in the secretory pathway." J. Biol. Chem. (1999) 274(30): 20745-20748.
International Search Report for Application PCT/US12/52884 dated Nov. 20, 2012.
International Search Report for Application PCT/US14/36460 dated Oct. 10, 2014.
International Search Report for Application PCT/US14/36466 dated Dec. 1, 2014.
International Search Report for Application PCT/US14/36462 dated Dec. 23, 2014.
International Search Report for Application PCT/US14/56630 dated Dec. 24, 2014.
International Search Report for Application PCT/US14/43731 dated Dec. 10, 2014.
International Search Report for Application PCT/US14/36463 dated Dec. 30, 2014.

* cited by examiner

COMPOSITIONS AND METHODS FOR MODULATING ANGIOPOIETIN-LIKE 3 EXPRESSION

SEQUENCE LISTING

The present application is being filed along with a Sequence Listing in electronic format. The Sequence Listing is provided as a file entitled BIOL0254USSEQ_ST25.txt, created on Apr. 28, 2015 which is 0.98 MB in size. The information in the electronic format of the sequence listing is incorporated herein by reference in its entirety.

FIELD OF THE INVENTION

Provided herein are methods, compounds, and compositions for reducing expression of angiopoietin-like 3 (ANGPTL3) mRNA and protein in an animal. Also, provided herein are methods, compounds, and compositions having an ANGPTL3 inhibitor for reducing ANGPTL3 related diseases or conditions in an animal. Such methods, compounds, and compositions are useful, for example, to treat, prevent, delay or ameliorate any one or more of cardiovascular disease or metabolic syndrome, or a symptom thereof, in an animal.

BACKGROUND

Diabetes and obesity (sometimes collectively referred to as "diabesity") are interrelated in that obesity is known to exacerbate the pathology of diabetes and greater than 60% of diabetics are obese. Most human obesity is associated with insulin resistance and leptin resistance. In fact, it has been suggested that obesity may have an even greater impact on insulin action than diabetes itself (Sindelka et al., *Physiol Res.*, 2002, 51, 85-91). Additionally, several compounds on the market for the treatment of diabetes are known to induce weight gain, a very undesirable side effect to the treatment of this disease.

Cardiovascular disease is also interrelated to obesity and diabetes. Cardiovascular disease encompasses a wide variety of etiologies and has an equally wide variety of causative agents and interrelated players. Many causative agents contribute to symptoms such as elevated plasma levels of cholesterol, including non-high density lipoprotein cholesterol (non-HDL-C), as well as other lipid-related disorders. Such lipid-related disorders, generally referred to as dyslipidemia, include hyperlipidemia, hypercholesterolemia and hypertriglyceridemia among other indications. Elevated non-HDL cholesterol is associated with atherogenesis and its sequelae, including cardiovascular diseases such as arteriosclerosis, coronary artery disease, myocardial infarction, ischemic stroke, and other forms of heart disease. These rank as the most prevalent types of illnesses in industrialized countries. Indeed, an estimated 12 million people in the United States suffer with coronary artery disease and about 36 million require treatment for elevated cholesterol levels.

Epidemiological and experimental evidence has shown that high levels of circulating triglyceride (TG) can contribute to cardiovascular disease and a myriad of metabolic disorders (Valdivielso et al., 2009, *Atherosclerosis* Zhang et al., 2008, *Circ Res.* 1; 102(2):250-6). TG derived from either exogenous or endogenous sources is incorporated and secreted in chylomicrons from the intestine or in very low density lipoproteins (VLDL) from the liver. Once in circulation, TG is hydrolyzed by lipoprotein lipase (LpL) and the resulting free fatty acids can then be taken up by local tissues and used as an energy source. Due to the profound effect LpL has on plasma TG and metabolism in general, discovering and developing compounds that affect LpL activity are of great interest.

Metabolic syndrome is a combination of medical disorders that increase one's risk for cardiovascular disease and diabetes. The symptoms, including high blood pressure, high triglycerides, decreased HDL and obesity, tend to appear together in some individuals. It affects a large number of people in a clustered fashion. In some studies, the prevalence in the USA is calculated as being up to 25% of the population. Metabolic syndrome is known under various other names, such as (metabolic) syndrome X, insulin resistance syndrome, Reaven's syndrome or CHAOS. With the high prevalence of cardiovascular disorders and metabolic disorders there remains a need for improved approaches to treat these conditions The angiopoietins are a family of secreted growth factors. Together with their respective endothelium-specific receptors, the angiopoietins play important roles in angiogenesis. One family member, angiopoietin-like 3 (also known as angiopoietin-like protein 3, ANGPT5, ANGPTL3, or angiopoietin 5), is predominantly expressed in the liver, and is thought to play a role in regulating lipid metabolism (Kaplan et al., *J. Lipid Res.*, 2003, 44, 136-143). Genome-wide association scans (GWAS) surveying the genome for common variants associated with plasma concentrations of HDL, LDL and triglyceride found an association between triglycerides and single-nucleotide polymorphisms (SNPs) near ANGPTL3 (Willer et al., Nature Genetics, 2008, 40(2):161-169). Individuals with homozygous ANGPTL3 loss-of-function mutations present with low levels of all atherogenic plasma lipids and lipoproteins, such as total cholesterol (TC) and TG, low density lipoprotein cholesterol (LDL-C), apolipoprotein B (apoB), non-HDL-C, as well as HDL-C (Romeo et al. 2009, *J Clin Invest*, 119(1):70-79; Musunuru et al. 2010 *N Engl J Med*, 363:2220-2227; Martin-Campos et al. 2012, *Clin Chim Acta*, 413:552-555; Minicocci et al. 2012, *J Clin Endocrinol Metab*, 97:e1266-1275; Noto et al. 2012, *Arterioscler Thromb Vasc Biol*, 32:805-809; Pisciotta et al. 2012, *Circulation Cardiovasc Genet*, 5:42-50). This clinical phenotype has been termed familial combined hypolipidemia (FHBL2). Despite reduced secretion of VLDL, subjects with FHBL2 do not have increased hepatic fat content. They also appear to have lower plasma glucose and insulin levels, and importantly, both diabetes and cardiovascular disease appear to be absent from these subjects. No adverse clinical phenotypes have been reported to date (Minicocci et al. 2013, *J of Lipid Research*, 54:3481-3490). Reduction of ANGPTL3 has been shown to lead to a decrease in TG, cholesterol and LDL levels in animal models (U.S. Ser. No. 13/520,997; PCT Publication WO 2011/085271). Mice deficient in ANGPTL3 have very low plasma triglyceride (TG) and cholesterol levels, while overexpression produces the opposite effects (Koishi et al. 2002; Koster 2005; Fujimoto 2006). Accordingly, the potential role of ANGPTL3 in lipid metabolism makes it an attractive target for therapeutic intervention.

To date, therapeutic strategies to treat cardiometabolic disease by directly targeting ANGPTL3 levels have been limited. ANGPTL3 polypeptide fragments (U.S. Ser. No. 12/128,545), anti-ANGPTL3 antibodies (U.S. Ser. No. 12/001,012) and ANGPTL3 nucleic acid inhibitors including antisense oligonucleotides (U.S. Ser. No. 13/520,997; PCT Publication WO 2011/085271; incorporated by reference herein, in their entirety) have previously been suggested or developed, but none of the compounds directly targeting ANGPTL3 have been approved for treating cardiometabolic disease. Accordingly, there is an unmet need for highly potent and tolerable compounds to inhibit ANGPTL3. The invention disclosed herein relates to the discovery of novel, highly potent inhibitors of ANGPTL3 expression and their use in treatment.

SUMMARY OF THE INVENTION

Provided herein are compositions and methods for modulating expression of ANGPTL3 mRNA and protein. In certain embodiments, the composition is an ANGPTL3 specific inhibitor. In certain embodiments, the ANGPTL3 specific inhibitor decreases expression of ANGPTL3 mRNA and protein.

In certain embodiments, the composition is an ANGPTL3 specific inhibitor. In certain embodiments, the ANGPTL3 specific inhibitor is a nucleic acid. In certain embodiments, the nucleic acid is an antisense compound. In certain embodiments, the antisense compound is a modified oligonucleotide. In certain embodiments, the antisense compound is a modified oligonucleotide with a conjugate group attached.

In certain embodiments, the ANGPTL3 specific inhibitor is a modified oligonucleotide with a conjugate group, wherein the modified oligonucleotide consists of 12 to 30 linked nucleosides and having a nucleobase sequence comprising at least 8, least 9, least 10, least 11, at least 12, least 13, at least 14, at least 15, at least 16, least 17, at least 18, at least 19, or 20 contiguous nucleobases of the nucleobase sequence of SEQ ID NO: 77.

In certain embodiments, the ANGPTL3 specific inhibitor is a modified oligonucleotide with a conjugate group, wherein the modified oligonucleotide consists of 12 to 30 linked nucleosides and comprising a nucleobase sequence comprising a portion of at least 8 contiguous nucleobases complementary to an equal length portion of nucleobases 1140-1159 of SEQ ID NO: 1, wherein the nucleobase sequence of the modified oligonucleotide is at least 80% complementary to SEQ ID NO: 1.

In certain embodiments, the ANGPTL3 specific inhibitor is a modified oligonucleotide with a conjugate group, wherein the modified oligonucleotide consists of 12 to 30 linked nucleosides and comprising a nucleobase sequence comprising a portion of at least 8 contiguous nucleobases complementary to an equal length portion of nucleobases 9715-9734 of SEQ ID NO: 2, wherein the nucleobase sequence of the modified oligonucleotide is at least 80% complementary to SEQ ID NO: 2.

In certain embodiments, the ANGPTL3 specific inhibitor is a modified oligonucleotide with a conjugate group, wherein the modified oligonucleotide consists of 20 linked nucleosides and having a nucleobase sequence comprising at least 8 contiguous nucleobases of SEQ ID NO: 77, wherein the modified oligonucleotide comprises: (a) a gap segment consisting of ten linked deoxynucleosides; (b) a 5' wing segment consisting of five linked nucleosides; (c) a 3' wing segment consisting of five linked nucleosides; and wherein the gap segment is positioned between the 5' wing segment and the 3' wing segment, wherein each nucleoside of each wing segment comprises a 2'-O-methoxyethyl sugar, wherein each internucleoside linkage is a phosphorothioate linkage and wherein each cytosine residue is a 5-methylcytosine.

In certain embodiments, the ANGPTL3 specific inhibitor is a modified oligonucleotide with a conjugate group, wherein the modified oligonucleotide consists of 20 linked nucleosides and having a nucleobase sequence consisting of at least 8 contiguous nucleobases of SEQ ID NO: 77, wherein the modified oligonucleotide consists of: (a) a gap segment consisting of ten linked deoxynucleosides; (b) a 5' wing segment consisting of five linked nucleosides; (c) a 3' wing segment consisting of five linked nucleosides; and wherein the gap segment is positioned between the 5' wing segment and the 3' wing segment, wherein each nucleoside of each wing segment comprises a 2'-O-methoxyethyl sugar, wherein each internucleoside linkage is a phosphorothioate linkage and wherein each cytosine residue is a 5-methylcytosine.

In certain embodiments, the present disclosure provides conjugated antisense compounds. In certain embodiments, the present disclosure provides conjugated antisense compounds comprising an antisense oligonucleotide complementary to a nucleic acid transcript. In certain embodiments, the present disclosure provides methods comprising contacting a cell with a conjugated antisense compound comprising an antisense oligonucleotide complementary to a nucleic acid transcript. In certain embodiments, the present disclosure provides methods comprising contacting a cell with a conjugated antisense compound comprising an antisense oligonucleotide and reducing the amount or activity of a nucleic acid transcript in a cell.

The asialoglycoprotein receptor (ASGP-R) has been described previously. See e.g., Park et al., PNAS vol. 102, No. 47, pp 17125-17129 (2005). Such receptors are expressed on liver cells, particularly hepatocytes. Further, it has been shown that compounds comprising clusters of three N-acetyl-galactosamine (GalNAc) ligands are capable of binding to the ASGP-R, resulting in uptake of the compound into the cell. See e.g., Khorev et al., Bioorganic and Medicinal Chemistry, 16, 9, pp 5216-5231 (May 2008). Accordingly, conjugates comprising such GalNAc clusters have been used to facilitate uptake of certain compounds into liver cells, specifically hepatocytes. For example it has been shown that certain GalNAc-containing conjugates increase activity of duplex siRNA compounds in liver cells in vivo. In such instances, the GalNAc-containing conjugate is typically attached to the sense strand of the siRNA duplex. Since the sense strand is discarded before the antisense strand ultimately hybridizes with the target nucleic acid, there is little concern that the conjugate will interfere with activity. Typically, the conjugate is attached to the 3' end of the sense strand of the siRNA. See e.g., U.S. Pat. No. 8,106,022. Certain conjugate groups described herein are more active and/or easier to synthesize than conjugate groups previously described.

In certain embodiments of the present invention, conjugates are attached to single-stranded antisense compounds, including, but not limited to RNase H based antisense compounds and antisense compounds that alter splicing of a pre-mRNA target nucleic acid. In such embodiments, the conjugate should remain attached to the antisense compound long enough to provide benefit (improved uptake into cells) but then should either be cleaved, or otherwise not interfere with the subsequent steps necessary for activity, such as hybridization to a target nucleic acid and interaction with RNase H or enzymes associated with splicing or splice modulation. This balance of properties is more important in the setting of single-stranded antisense compounds than in siRNA compounds, where the conjugate may simply be attached to the sense strand. Disclosed herein are conjugated single-stranded antisense compounds having improved potency in liver cells in vivo compared with the same antisense compound lacking the conjugate. Given the required balance of properties for these compounds such improved potency is surprising.

In certain embodiments, conjugate groups herein comprise a cleavable moiety. As noted, without wishing to be bound by mechanism, it is logical that the conjugate should remain on the compound long enough to provide enhancement in uptake, but after that, it is desirable for some portion or, ideally, all of the conjugate to be cleaved, releasing the parent compound (e.g., antisense compound) in its most active form. In certain embodiments, the cleavable moiety is a cleavable nucleoside. Such embodiments take advantage of endogenous nucleases in the cell by attaching the rest of the conjugate (the cluster) to the antisense oligonucleotide through a nucleoside via one or more cleavable bonds, such as those of a phosphodiester linkage. In certain embodiments, the cluster is bound to the cleavable nucleoside through a phosphodiester linkage. In certain embodiments, the cleavable nucleoside is attached to the antisense oligonucleotide (antisense compound) by a phosphodiester linkage. In certain embodiments, the conjugate group may comprise two or three cleavable nucleosides. In such embodiments, such cleavable nucleosides are linked to one another, to the antisense compound and/or to the cluster via cleavable bonds (such as those of a phosphodiester linkage). Certain conjugates herein do not comprise a cleavable nucleoside and instead comprise a cleavable bond. It is shown that that sufficient cleavage of the conjugate from the oligonucleotide is provided by at least one bond that is vulnerable to cleavage in the cell (a cleavable bond).

In certain embodiments, conjugated antisense compounds are prodrugs. Such prodrugs are administered to an animal and are ultimately metabolized to a more active form. For example, conjugated antisense compounds are cleaved to remove all or part of the conjugate resulting in the active (or more active) form of the antisense compound lacking all or some of the conjugate.

In certain embodiments, conjugates are attached at the 5' end of an oligonucleotide. Certain such 5'-conjugates are cleaved more efficiently than counterparts having a similar conjugate group attached at the 3' end. In certain embodiments, improved activity may correlate with improved cleavage. In certain embodiments, oligonucleotides comprising a conjugate at the 5' end have greater efficacy than oligonucleotides comprising a conjugate at the 3' end (see, for example, Examples 56, 81, 83, and 84). Further, 5'-attachment allows simpler oligonucleotide synthesis. Typically, oligonucleotides are synthesized on a solid support in the 3' to 5' direction. To make a 3'-conjugated oligonucleotide, typically one attaches a pre-conjugated 3' nucleoside to the solid support and then builds the oligonucleotide as usual. However, attaching that conjugated nucleoside to the solid support adds complication to the synthesis. Further, using that approach, the conjugate is then present throughout the synthesis of the oligonucleotide and can become degraded during subsequent steps or may limit the sorts of reactions and reagents that can be used. Using the structures and techniques described herein for 5'-conjugated oligonucleotides, one can synthesize the oligonucleotide using standard automated techniques and introduce the conjugate with the final (5'-most) nucleoside or after the oligonucleotide has been cleaved from the solid support.

In view of the art and the present disclosure, one of ordinary skill can easily make any of the conjugates and conjugated oligonucleotides herein. Moreover, synthesis of certain such conjugates and conjugated oligonucleotides disclosed herein is easier and/or requires few steps, and is therefore less expensive than that of conjugates previously disclosed, providing advantages in manufacturing. For example, the synthesis of certain conjugate groups consists of fewer synthetic steps, resulting in increased yield, relative to conjugate groups previously described. Conjugate groups such as GalNAc3-10 in Example 46 and GalNAc3-7 in Example 48 are much simpler than previously described conjugates such as those described in U.S. Pat. No. 8,106,022 or U.S. Pat. No. 7,262,177 that require assembly of more chemical intermediates. Accordingly, these and other conjugates described herein have advantages over previously described compounds for use with any oligonucleotide, including single-stranded oligonucleotides and either strand of double-stranded oligonucleotides (e.g., siRNA).

Similarly, disclosed herein are conjugate groups having only one or two GalNAc ligands. As shown, such conjugates groups improve activity of antisense compounds. Such compounds are much easier to prepare than conjugates comprising three GalNAc ligands. Conjugate groups comprising one or two GalNAc ligands may be attached to any antisense compounds, including single-stranded oligonucleotides and either strand of double-stranded oligonucleotides (e.g., siRNA).

In certain embodiments, the conjugates herein do not substantially alter certain measures of tolerability. For example, it is shown herein that conjugated antisense compounds are not more immunogenic than unconjugated parent compounds. Since potency is improved, embodiments in which tolerability remains the same (or indeed even if tolerability worsens only slightly compared to the gains in potency) have improved properties for therapy.

In certain embodiments, conjugation allows one to alter antisense compounds in ways that have less attractive consequences in the absence of conjugation. For example, in certain embodiments, replacing one or more phosphorothioate linkages of a fully phosphorothioate antisense compound with phosphodiester linkages results in improvement in some measures of tolerability. For example, in certain instances, such antisense compounds having one or more phosphodiester are less immunogenic than the same compound in which each linkage is a phosphorothioate. However, in certain instances, as shown in Example 26, that same replacement of one or more phosphorothioate linkages with phosphodiester linkages also results in reduced cellular uptake and/or loss in potency. In certain embodiments, conjugated antisense compounds described herein tolerate such change in linkages with little or no loss in uptake and potency when compared to the conjugated full-phosphorothioate counterpart. In fact, in certain embodiments, for example, in Examples 44, 57, 59, and 86, oligonucleotides comprising a conjugate and at least one phosphodiester internucleoside linkage actually exhibit increased potency in vivo even relative to a full phosphorothioate counterpart also comprising the same conjugate. Moreover, since conjugation results in substantial increases in uptake/potency a small loss in that substantial gain may be acceptable to achieve improved tolerability. Accordingly, in certain embodiments, conjugated antisense compounds comprise at least one phosphodiester linkage.

In certain embodiments, conjugation of antisense compounds herein results in increased delivery, uptake and activity in hepatocytes. Thus, more compound is delivered to liver tissue. However, in certain embodiments, that increased delivery alone does not explain the entire increase in activity. In certain such embodiments, more compound enters hepatocytes. In certain embodiments, even that increased hepatocyte uptake does not explain the entire increase in activity. In such embodiments, productive uptake of the conjugated compound is increased. For example, as shown in Example 102, certain embodiments of GalNAc-containing conjugates increase enrichment of antisense oligonucleotides in hepatocytes versus non-parenchymal cells. This enrichment is beneficial for oligonucleotides that target genes that are expressed in hepatocytes.

In certain embodiments, conjugated antisense compounds herein result in reduced kidney exposure. For example, as shown in Example 20, the concentrations of antisense oligonucleotides comprising certain embodiments of GalNAc-containing conjugates are lower in the kidney than that of antisense oligonucleotides lacking a GalNAc-containing conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly for non-kidney targets, kidney accumulation is undesired.

In certain embodiments, the present disclosure provides conjugated antisense compounds represented by the formula:

A-B-C-D-(-E-F)$_q$ wherein
A is the antisense oligonucleotide;
B is the cleavable moiety
C is the conjugate linker
D is the branching group
each E is a tether;
each F is a ligand; and
q is an integer between 1 and 5.

In the above diagram and in similar diagrams herein, the branching group "D" branches as many times as is necessary to accommodate the number of (E-F) groups as indicated by "q". Thus, where q=1, the formula is:

A-B-C-D-E-F where q=2, the formula is:

where q=3, the formula is:

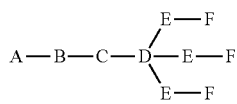

where q=4, the formula is:

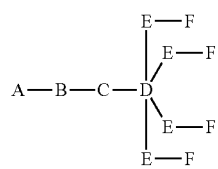

where q=5, the formula is:

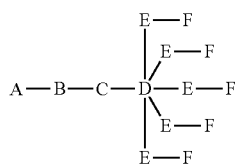

In certain embodiments, conjugated antisense compounds are provided having the structure:

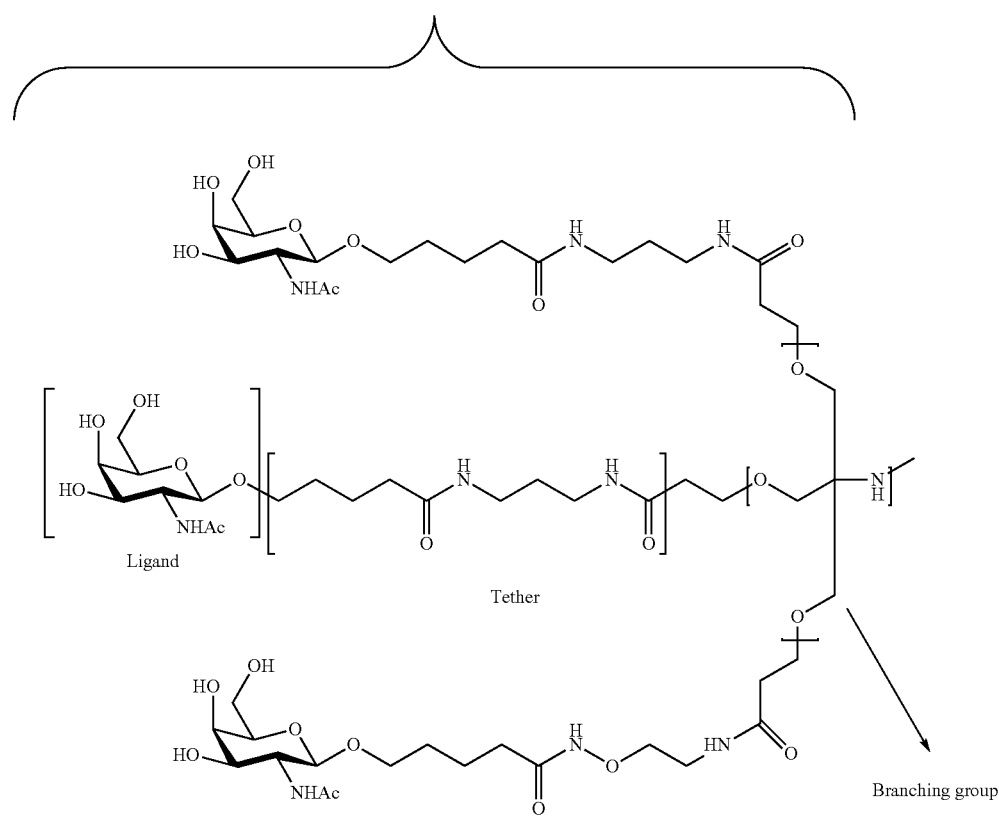

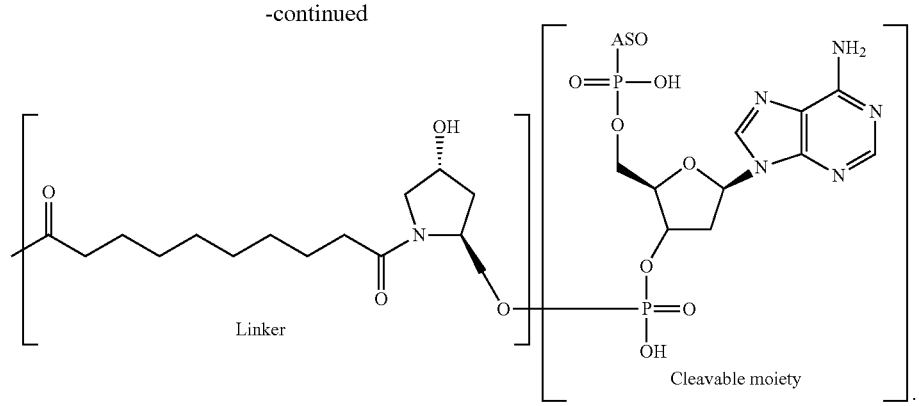
In certain embodiments, conjugated antisense compounds are provided having the structure:
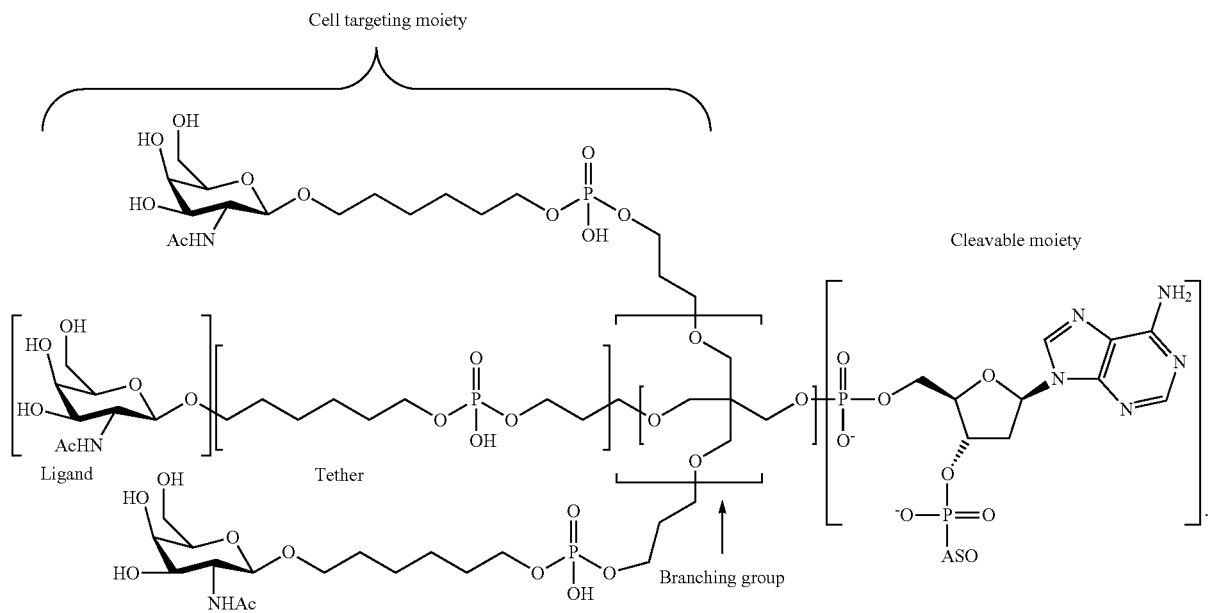
In certain embodiments, conjugated antisense compounds are provided having the structure:
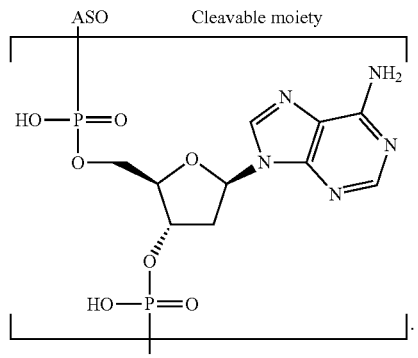

-continued

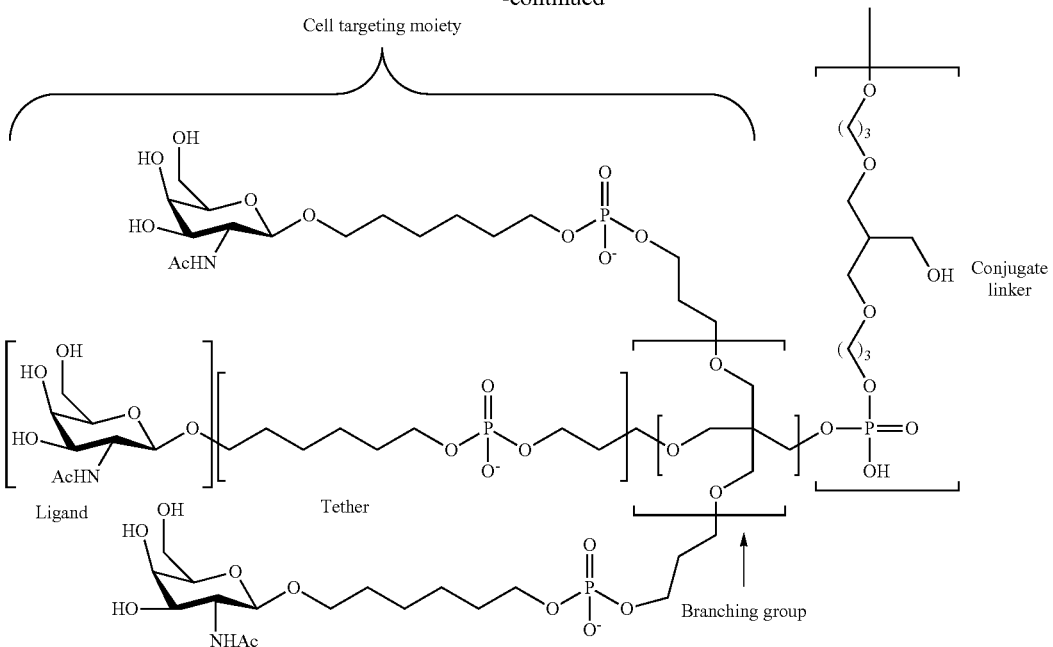

In certain embodiments, conjugated antisense compounds are provided having the structure:

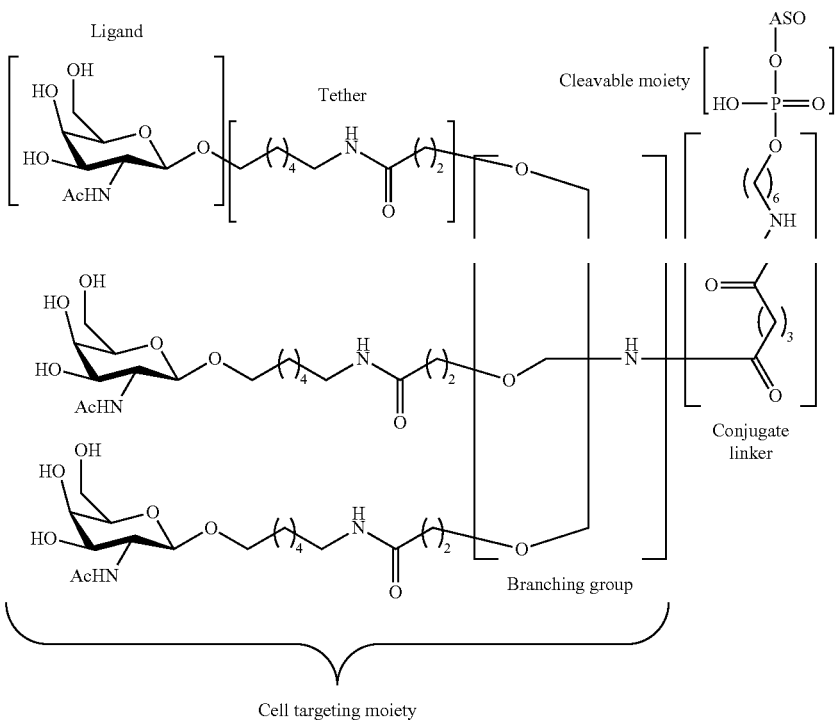

In embodiments having more than one of a particular variable (e.g., more than one "m" or "n"), unless otherwise indicated, each such particular variable is selected independently. Thus, for a structure having more than one n, each n is selected independently, so they may or may not be the same as one another.

In certain embodiments, the present disclosure provides conjugated antisense compounds represented by the following structure. In certain embodiments, the antisense compound comprises the modified oligonucleotide ISIS 563580 with a 5'-X, wherein X is a conjugate group comprising GalNAc. In certain embodiments, the antisense compound consists of the modified oligonucleotide ISIS 563580 with a 5'-X, wherein X is a conjugate group comprising GalNAc.

13                14
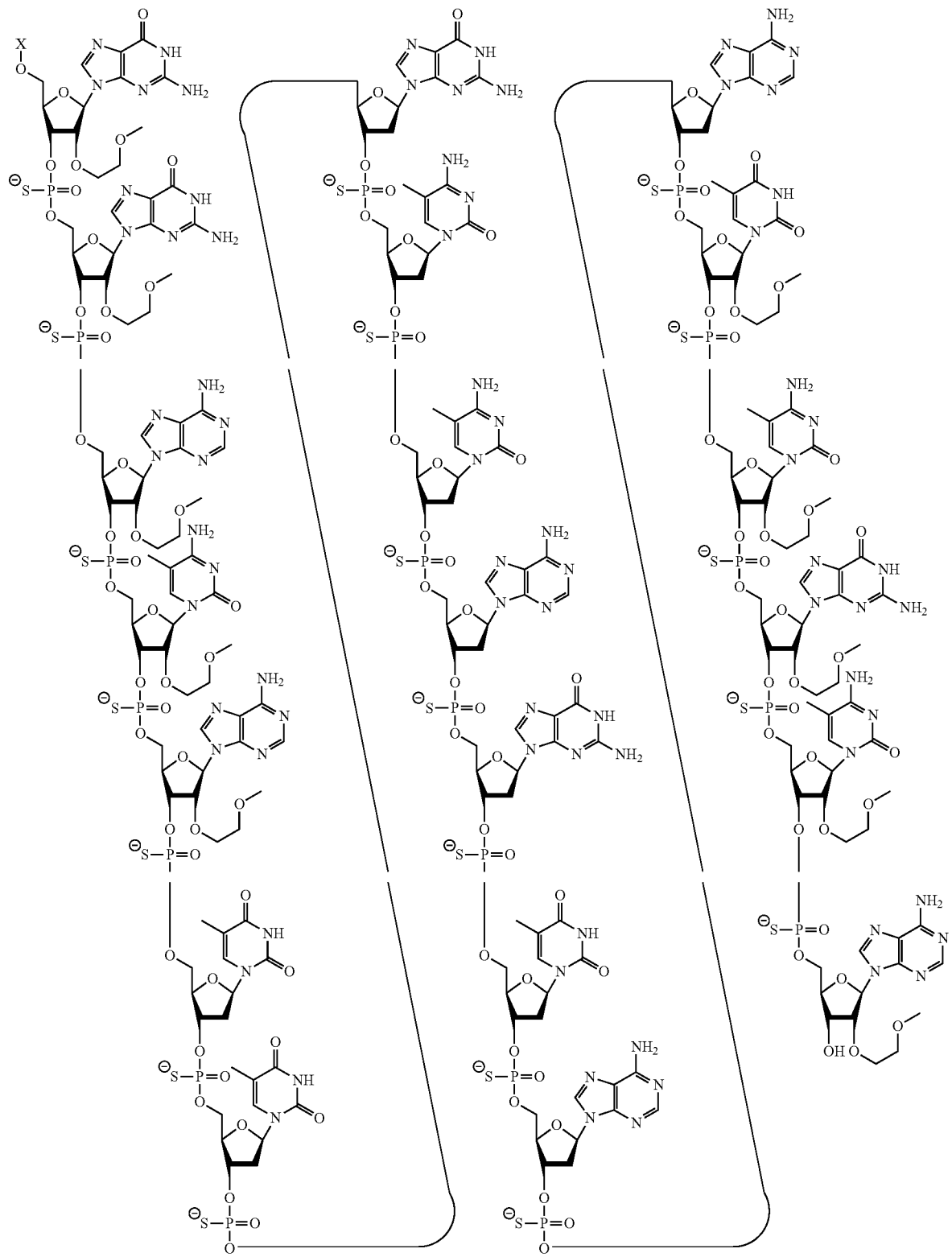

In certain embodiments, the present disclosure provides conjugated antisense compounds represented by the following structure. In certain embodiments, the antisense compound comprises the conjugated modified oligonucleotide ISIS 703801. In certain embodiments, the antisense compound consists of the conjugated modified oligonucleotide ISIS 703801.
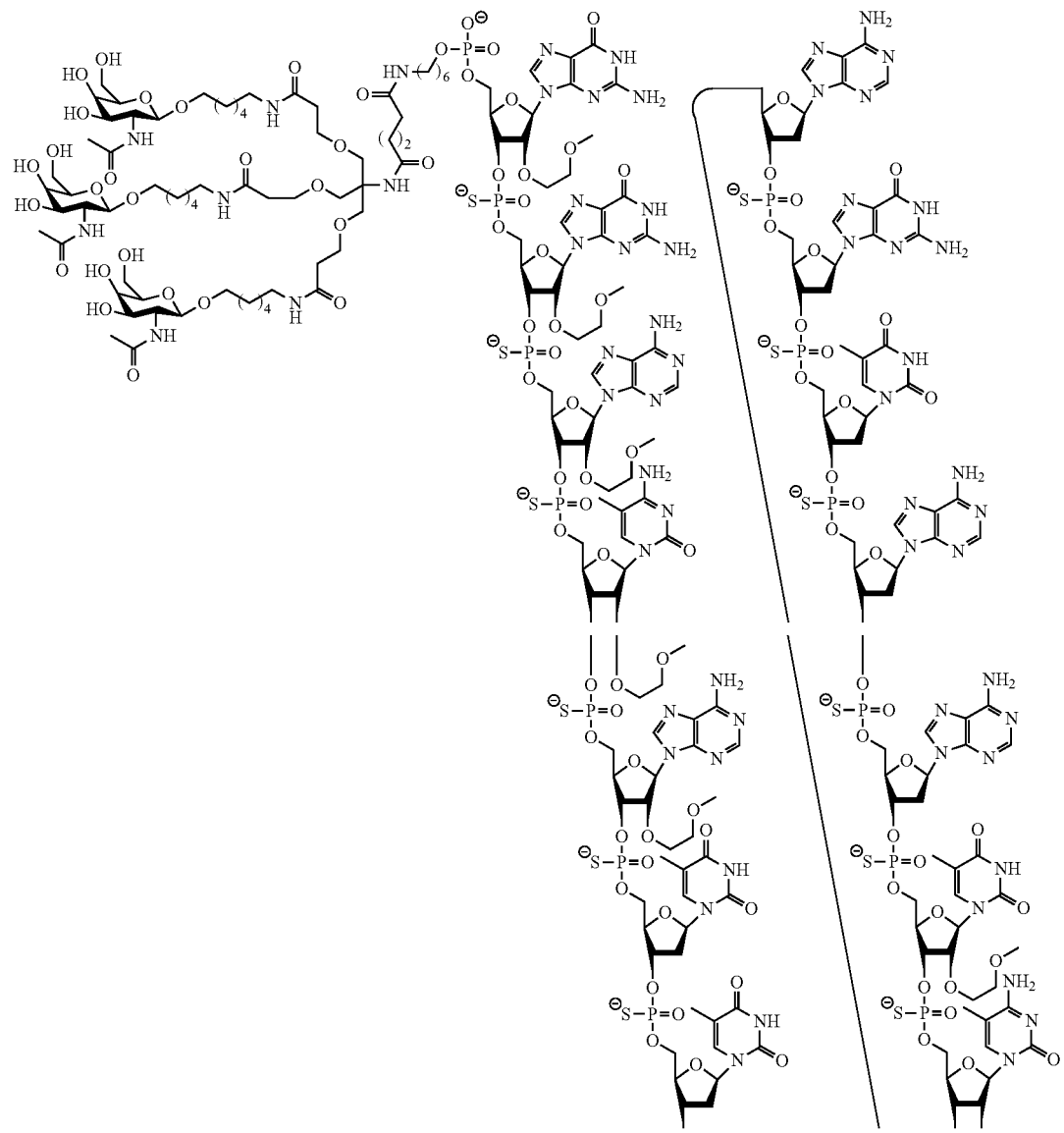

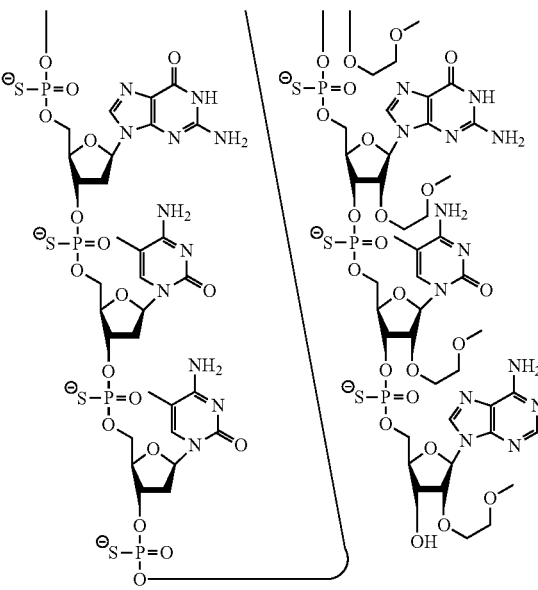
In certain embodiments, the present disclosure provides conjugated antisense compounds represented by the following structure. In certain embodiments, the antisense compound comprises the conjugated modified oligonucleotide ISIS 703802. In certain embodiments, the antisense compound consists of the conjugated modified oligonucleotide ISIS 703802.
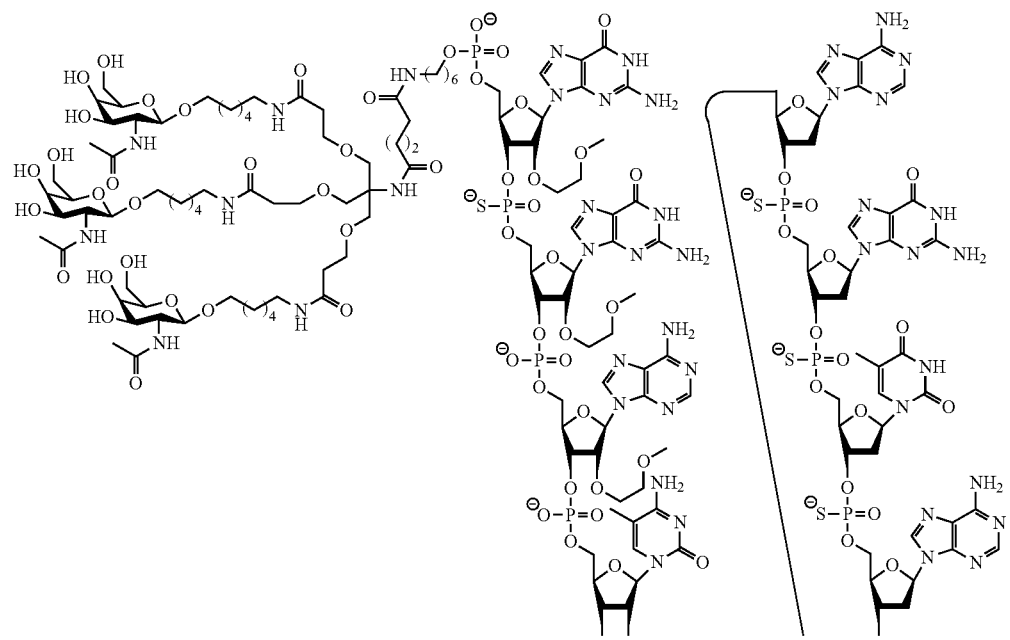

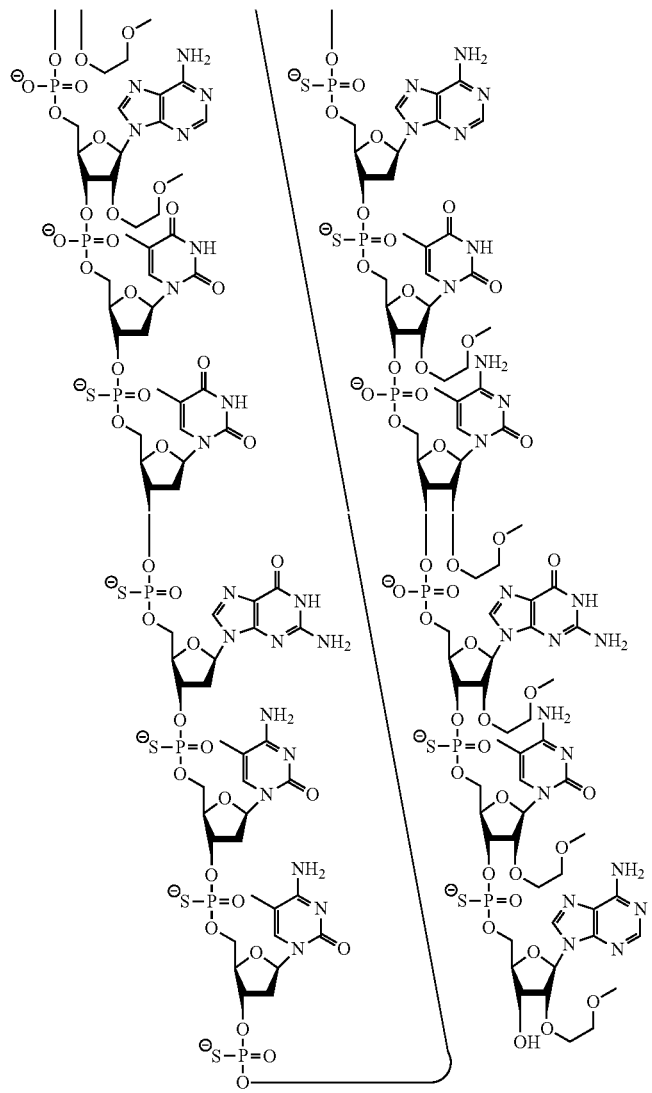

In certain embodiments, the present disclosure provides conjugated antisense compounds represented by the following structure. In certain embodiments, the antisense compound comprises a modified oligonucleotide with the nucleobase sequence of SEQ ID NO: 77 with a 5'-GalNAc with variability in the sugar mods of the wings. In certain embodiments, the antisense compound consists of a modified oligonucleotide with the nucleobase sequence of SEQ ID NO: 77 with a 5'-GalNAc with variability in the sugar mods of the wings.

21 22
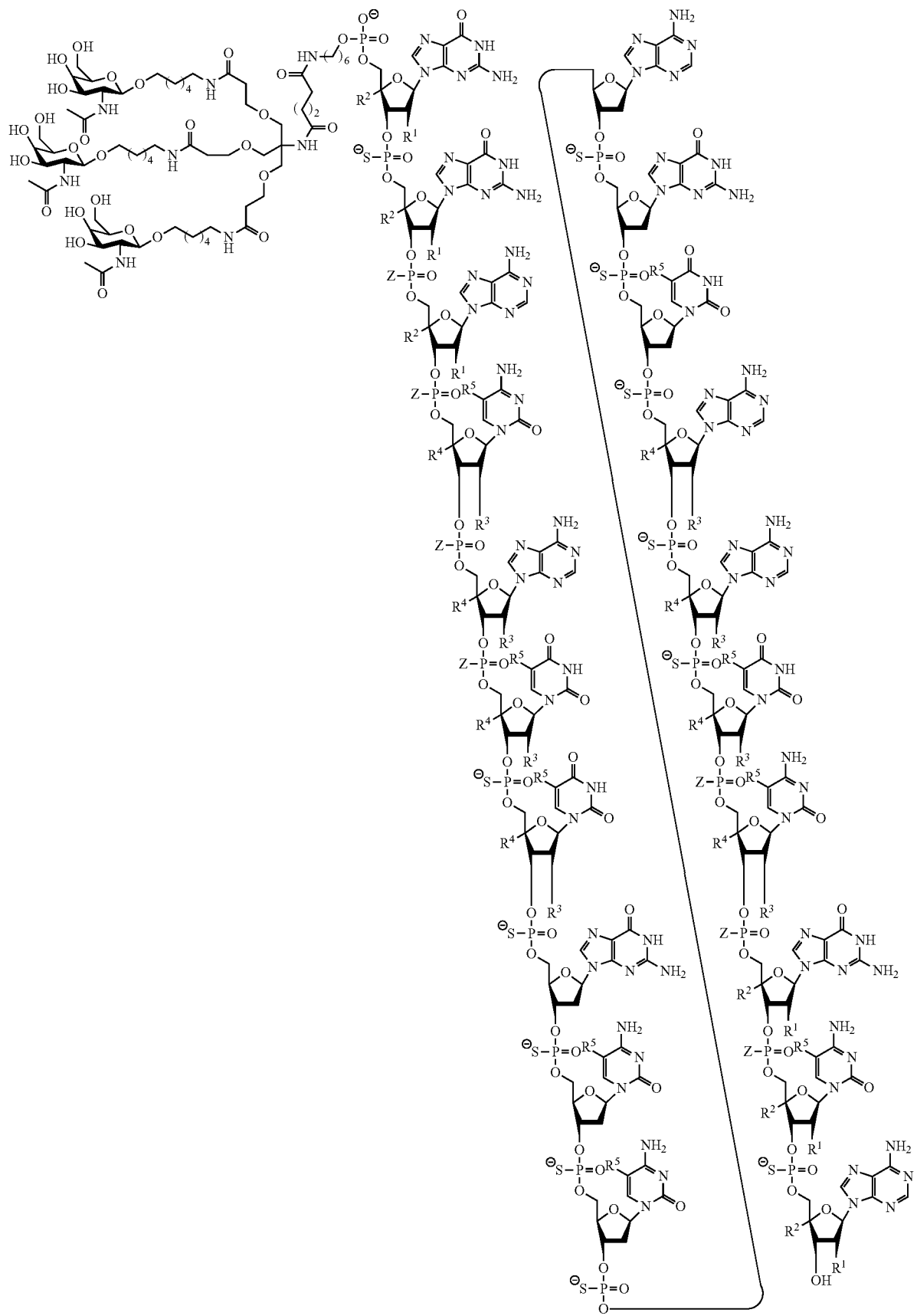

wherein either $R^1$ is —OCH$_2$CH$_2$OCH$_3$ (MOE) and $R^2$ is H; or $R^1$ and $R^2$ together form a bridge, wherein $R^1$ is —O— and $R^2$ is —CH$_2$—, —CH(CH$_3$)—, or —CH$_2$CH$_2$—, and $R^1$ and $R^2$ are directly connected such that the resulting bridge is selected from: —O—CH$_2$—, —O—CH(CH$_3$)—, and —O—CH$_2$CH$_2$—;

and for each pair of $R^3$ and $R^4$ on the same ring, independently for each ring: either $R^3$ is selected from H and —OCH$_2$CH$_2$OCH$_3$ and $R^4$ is H; or $R^3$ and $R^4$ together form a bridge, wherein $R^3$ is —O—, and $R^4$ is —CH$_2$—, —CH(CH$_3$)—, or —CH$_2$CH$_2$— and $R^3$ and $R^4$ are directly connected such that the resulting bridge is selected from: —O—CH$_2$—, —O—CH(CH$_3$)—, and —O—CH$_2$CH$_2$—;

and $R^5$ is selected from H and —CH$_3$;

and Z is selected from S$^-$ and O$^-$.

Certain embodiments provide a composition comprising a conjugated antisense compound described herein, or a salt thereof, and a pharmaceutically acceptable carrier or diluent.

In certain embodiments, the modulation of ANGPTL3 expression occurs in a cell or tissue. In certain embodiments, the modulations occur in a cell or tissue in an animal. In certain embodiments, the animal is a human. In certain embodiments, the modulation is a reduction in ANGPTL3 mRNA level. In certain embodiments, the modulation is a reduction in ANGPTL3 protein level. In certain embodiments, both ANGPTL3 mRNA and protein levels are reduced. Such reduction may occur in a time-dependent or in a dose-dependent manner.

Certain embodiments provide compositions and methods for use in therapy. Certain embodiments provide compositions and methods for preventing, treating, delaying, slowing the progression and/or ameliorating ANGPTL3 related diseases, disorders, and conditions. In certain embodiments, such diseases, disorders, and conditions are cardiovascular and/or metabolic diseases, disorders, and conditions. In certain embodiments, the compositions and methods for therapy include administering an ANGPTL3 specific inhibitor to an individual in need thereof. In certain embodiments, the ANGPTL3 specific inhibitor is a nucleic acid. In certain embodiments, the nucleic acid is an antisense compound. In certain embodiments, the antisense compound is a modified oligonucleotide. In certain embodiments, the antisense compound is a modified oligonucleotide with a conjugate group attached.

DETAILED DESCRIPTION OF THE INVENTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

DEFINITIONS

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques can be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., 21$^{st}$ edition, 2005; and "Antisense Drug Technology, Principles, Strategies, and Applications" Edited by Stanley T. Crooke, CRC Press, Boca Raton, Fla.; and Sambrook et al., "Molecular Cloning, A laboratory Manual," 2$^{nd}$ Edition, Cold Spring Harbor Laboratory Press, 1989, which are hereby incorporated by reference for any purpose. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

As used herein, "nucleoside" means a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety.

As used herein, "chemical modification" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

As used herein, "furanosyl" means a structure comprising a 5-membered ring comprising four carbon atoms and one oxygen atom.

As used herein, "naturally occurring sugar moiety" means a ribofuranosyl as found in naturally occurring RNA or a deoxyribofuranosyl as found in naturally occurring DNA.

As used herein, "sugar moiety" means a naturally occurring sugar moiety or a modified sugar moiety of a nucleoside.

As used herein, "modified sugar moiety" means a substituted sugar moiety or a sugar surrogate.

As used herein, "substituted sugar moiety" means a furanosyl that is not a naturally occurring sugar moiety. Substituted sugar moieties include, but are not limited to furanosyls comprising substituents at the 2'-position, the 3'-position, the 5'-position and/or the 4'-position. Certain substituted sugar moieties are bicyclic sugar moieties.

As used herein, "2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring.

As used herein, "MOE" means —OCH$_2$CH$_2$OCH$_3$.

As used herein, "2'-F nucleoside" refers to a nucleoside comprising a sugar comprising fluorine at the 2' position. Unless otherwise indicated, the fluorine in a 2'-F nucleoside is in the ribo position (replacing the OH of a natural ribose).

As used herein the term "sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

As used herein, "bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

As used herein, "nucleotide" means a nucleoside further comprising a phosphate linking group. As used herein, "linked nucleosides" may or may not be linked by phosphate linkages and thus includes, but is not limited to "linked nucleotides." As used herein, "linked nucleosides" are nucleosides that are connected in a continuous sequence (i.e. no additional nucleosides are present between those that are linked).

As used herein, "nucleobase" means a group of atoms that can be linked to a sugar moiety to create a nucleoside that is capable of incorporation into an oligonucleotide, and wherein the group of atoms is capable of bonding with a complementary naturally occurring nucleobase of another oligonucleotide or nucleic acid. Nucleobases may be naturally occurring or may be modified. "Nucleobase sequence" means the order of contiguous nucleobases independent of any sugar, linkage, or nucleobase modification.

As used herein the terms, "unmodified nucleobase" or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

As used herein, "modified nucleobase" means any nucleobase that is not a naturally occurring nucleobase.

As used herein, "modified nucleoside" means a nucleoside comprising at least one chemical modification compared to naturally occurring RNA or DNA nucleosides. Modified nucleosides comprise a modified sugar moiety and/or a modified nucleobase.

As used herein, "bicyclic nucleoside" or "BNA" means a nucleoside comprising a bicyclic sugar moiety.

As used herein, "constrained ethyl nucleoside" or "cEt" means a nucleoside comprising a bicyclic sugar moiety comprising a 4'-CH(CH$_3$)—O-2'bridge.

As used herein, "locked nucleic acid nucleoside" or "LNA" means a nucleoside comprising a bicyclic sugar moiety comprising a 4'-CH$_2$—O-2'bridge.

As used herein, "2'-substituted nucleoside" means a nucleoside comprising a substituent at the 2'-position other than H or OH. Unless otherwise indicated, a 2'-substituted nucleoside is not a bicyclic nucleoside.

As used herein, "deoxynucleoside" means a nucleoside comprising 2'-H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

As used herein, "oligonucleotide" means a compound comprising a plurality of linked nucleosides. In certain embodiments, an oligonucleotide comprises one or more unmodified ribonucleosides (RNA) and/or unmodified deoxyribonucleosides (DNA) and/or one or more modified nucleosides.

As used herein "oligonucleoside" means an oligonucleotide in which none of the internucleoside linkages contains a phosphorus atom. As used herein, oligonucleotides include oligonucleosides.

As used herein, "modified oligonucleotide" means an oligonucleotide comprising at least one modified nucleoside and/or at least one modified internucleoside linkage.

As used herein, "linkage" or "linking group" means a group of atoms that link together two or more other groups of atoms.

As used herein "internucleoside linkage" means a covalent linkage between adjacent nucleosides in an oligonucleotide.

As used herein "naturally occurring internucleoside linkage" means a 3' to 5' phosphodiester linkage.

As used herein, "modified internucleoside linkage" means any internucleoside linkage other than a naturally occurring internucleoside linkage.

As used herein, "terminal internucleoside linkage" means the linkage between the last two nucleosides of an oligonucleotide or defined region thereof.

As used herein, "phosphorus linking group" means a linking group comprising a phosphorus atom. Phosphorus linking groups include without limitation groups having the formula:

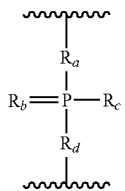

wherein:
R$_a$ and R$_d$ are each, independently, O, S, CH$_2$, NH, or NJ$_1$
wherein J$_1$ is C$_1$-C$_6$ alkyl or substituted C$_1$-C$_6$ alkyl;
R$_b$ is O or S;
R$_c$ is OH, SH, C$_1$-C$_6$ alkyl, substituted C$_1$-C$_6$ alkyl, C$_1$-C$_6$ alkoxy, substituted C$_1$-C$_6$ alkoxy, amino or substituted amino; and
J$_1$ is R$_b$ is O or S.

Phosphorus linking groups include without limitation, phosphodiester, phosphorothioate, phosphorodithioate, phosphonate, phosphoramidate, phosphorothioamidate, thionoalkylphosphonate, phosphotriesters, thionoalkylphosphotriester and boranophosphate.

As used herein, "internucleoside phosphorus linking group" means a phosphorus linking group that directly links two nucleosides.

As used herein, "non-internucleoside phosphorus linking group" means a phosphorus linking group that does not directly link two nucleosides. In certain embodiments, a non-internucleoside phosphorus linking group links a nucleoside to a group other than a nucleoside. In certain embodiments, a non-internucleoside phosphorus linking group links two groups, neither of which is a nucleoside.

As used herein, "neutral linking group" means a linking group that is not charged. Neutral linking groups include without limitation phosphotriesters, methylphosphonates, MMI ($-CH_2-N(CH_3)-O-$), amide-3 ($-CH_2-C(=O)-N(H)-$), amide-4 ($-CH_2-N(H)-C(=O)-$), formacetal ($-O-CH_2-O-$), and thioformacetal ($-S-CH_2-O-$). Further neutral linking groups include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook Eds. ACS Symposium Series 580; Chapters 3 and 4, (pp. 40-65)). Further neutral linking groups include nonionic linkages comprising mixed N, O, S and $CH_2$ component parts.

As used herein, "internucleoside neutral linking group" means a neutral linking group that directly links two nucleosides.

As used herein, "non-internucleoside neutral linking group" means a neutral linking group that does not directly link two nucleosides. In certain embodiments, a non-internucleoside neutral linking group links a nucleoside to a group other than a nucleoside. In certain embodiments, a non-internucleoside neutral linking group links two groups, neither of which is a nucleoside.

As used herein, "oligomeric compound" means a polymeric structure comprising two or more sub-structures. In certain embodiments, an oligomeric compound comprises an oligonucleotide. In certain embodiments, an oligomeric compound comprises one or more conjugate groups and/or terminal groups. In certain embodiments, an oligomeric compound consists of an oligonucleotide. Oligomeric compounds also include naturally occurring nucleic acids. In certain embodiments, an oligomeric compound comprises a backbone of one or more linked monomeric subunits where each linked monomeric subunit is directly or indirectly attached to a heterocyclic base moiety. In certain embodiments, oligomeric compounds may also include monomeric subunits that are not linked to a heterocyclic base moiety, thereby providing abasic sites. In certain embodiments, the linkages joining the monomeric subunits, the sugar moieties or surrogates and the heterocyclic base moieties can be independently modified. In certain embodiments, the linkage-sugar unit, which may or may not include a heterocyclic base, may be substituted with a mimetic such as the monomers in peptide nucleic acids.

As used herein, "terminal group" means one or more atom attached to either, or both, the 3' end or the 5' end of an oligonucleotide. In certain embodiments a terminal group is a conjugate group. In certain embodiments, a terminal group comprises one or more terminal group nucleosides.

As used herein, "conjugate" or "conjugate group" means an atom or group of atoms bound to an oligonucleotide or oligomeric compound. In general, conjugate groups modify one or more properties of the compound to which they are attached, including, but not limited to pharmacodynamic, pharmacokinetic, binding, absorption, cellular distribution, cellular uptake, charge and/or clearance properties.

As used herein, "conjugate linker" or "linker" in the context of a conjugate group means a portion of a conjugate group comprising any atom or group of atoms and which covalently link (1) an oligonucleotide to another portion of the conjugate group or (2) two or more portions of the conjugate group.

Conjugate groups are shown herein as radicals, providing a bond for forming covalent attachment to an oligomeric compound such as an antisense oligonucleotide. In certain embodiments, the point of attachment on the oligomeric compound is the 3'-oxygen atom of the 3'-hydroxyl group of the 3' terminal nucleoside of the oligomeric compound. In certain embodiments the point of attachment on the oligomeric compound is the 5'-oxygen atom of the 5'-hydroxyl group of the 5' terminal nucleoside of the oligomeric compound. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and a carbohydrate cluster portion, such as a GalNAc cluster portion. Such carbohydrate cluster portion comprises: a targeting moiety and, optionally, a conjugate linker. In certain embodiments, the carbohydrate cluster portion is identified by the number and identity of the ligand. For example, in certain embodiments, the carbohydrate cluster portion comprises 3 GalNAc groups and is designated "GalNAc$_3$". In certain embodiments, the carbohydrate cluster portion comprises 4 GalNAc groups and is designated "GalNAc$_4$". Specific carbohydrate cluster portions (having specific tether, branching and conjugate linker groups) are described herein and designated by Roman numeral followed by subscript "a". Accordingly "GalNac3-1$_a$" refers to a specific carbohydrate cluster portion of a conjugate group having 3 GalNac groups and specifically identified tether, branching and linking groups. Such carbohydrate cluster fragment is attached to an oligomeric compound via a cleavable moiety, such as a cleavable bond or cleavable nucleoside.

As used herein, "cleavable moiety" means a bond or group that is capable of being split under physiological conditions. In certain embodiments, a cleavable moiety is cleaved inside a cell or sub-cellular compartments, such as a lysosome. In certain embodiments, a cleavable moiety is cleaved by endogenous enzymes, such as nucleases. In certain embodiments, a cleavable moiety comprises a group of atoms having one, two, three, four, or more than four cleavable bonds.

As used herein, "cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

As used herein, "carbohydrate cluster" means a compound having one or more carbohydrate residues attached to a scaffold or linker group. (see, e.g., Maier et al., "Synthesis of Antisense Oligonucleotides Conjugated to a Multivalent Carbohydrate Cluster for Cellular Targeting," *Bioconjugate Chemistry*, 2003, (14): 18-29, which is incorporated herein by reference in its entirety, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, (47): 5798-5808, for examples of carbohydrate conjugate clusters).

As used herein, "modified carbohydrate" means any carbohydrate having one or more chemical modifications relative to naturally occurring carbohydrates.

As used herein, "carbohydrate derivative" means any compound which may be synthesized using a carbohydrate as a starting material or intermediate.

As used herein, "carbohydrate" means a naturally occurring carbohydrate, a modified carbohydrate, or a carbohydrate derivative.

As used herein "protecting group" means any compound or protecting group known to those having skill in the art. Non-limiting examples of protecting groups may be found in "Protective Groups in Organic Chemistry", T. W. Greene, P. G. M. Wuts, ISBN 0-471-62301-6, John Wiley & Sons, Inc, New York, which is incorporated herein by reference in its entirety.

As used herein, "single-stranded" means an oligomeric compound that is not hybridized to its complement and which lacks sufficient self-complementarity to form a stable self-duplex.

As used herein, "double stranded" means a pair of oligomeric compounds that are hybridized to one another or a single self-complementary oligomeric compound that forms a hairpin structure. In certain embodiments, a double-stranded oligomeric compound comprises a first and a second oligomeric compound.

As used herein, "antisense compound" means a compound comprising or consisting of an oligonucleotide at least a portion of which is complementary to a target nucleic acid to which it is capable of hybridizing, resulting in at least one antisense activity.

As used herein, "antisense activity" means any detectable and/or measurable change attributable to the hybridization of an antisense compound to its target nucleic acid. In certain embodiments, antisense activity includes modulation of the amount or activity of a target nucleic acid transcript (e.g. mRNA). In certain embodiments, antisense activity includes modulation of the splicing of pre-mRNA.

As used herein, "RNase H based antisense compound" means an antisense compound wherein at least some of the antisense activity of the antisense compound is attributable to hybridization of the antisense compound to a target nucleic acid and subsequent cleavage of the target nucleic acid by RNase H.

As used herein, "RISC based antisense compound" means an antisense compound wherein at least some of the antisense activity of the antisense compound is attributable to the RNA Induced Silencing Complex (RISC).

As used herein, "detecting" or "measuring" means that a test or assay for detecting or measuring is performed. Such detection and/or measuring may result in a value of zero. Thus, if a test for detection or measuring results in a finding of no activity (activity of zero), the step of detecting or measuring the activity has nevertheless been performed.

As used herein, "detectable and/or measureable activity" means a statistically significant activity that is not zero.

As used herein, "essentially unchanged" means little or no change in a particular parameter, particularly relative to another parameter which changes much more. In certain embodiments, a parameter is essentially unchanged when it changes less than 5%. In certain embodiments, a parameter is essentially unchanged if it changes less than two-fold while another parameter changes at least ten-fold. For example, in certain embodiments, an antisense activity is a change in the amount of a target nucleic acid. In certain such embodiments, the amount of a non-target nucleic acid is essentially unchanged if it changes much less than the target nucleic acid does, but the change need not be zero.

As used herein, "expression" means the process by which a gene ultimately results in a protein. Expression includes, but is not limited to, transcription, post-transcriptional modification (e.g., splicing, polyadenlyation, addition of 5'-cap), and translation.

As used herein, "target nucleic acid" means a nucleic acid molecule to which an antisense compound is intended to hybridize to result in a desired antisense activity. Antisense oligonucleotides have sufficient complementarity to their target nucleic acids to allow hybridization under physiological conditions.

As used herein, "nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In certain embodiments, complementary nucleobase means a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair. Nucleobases comprising certain modifications may maintain the ability to pair with a counterpart nucleobase and thus, are still capable of nucleobase complementarity.

As used herein, "non-complementary" in reference to nucleobases means a pair of nucleobases that do not form hydrogen bonds with one another.

As used herein, "complementary" in reference to oligomeric compounds (e.g., linked nucleosides, oligonucleotides, or nucleic acids) means the capacity of such oligomeric compounds or regions thereof to hybridize to another oligomeric compound or region thereof through nucleobase complementarity. Complementary oligomeric compounds need not have nucleobase complementarity at each nucleoside. Rather, some mismatches are tolerated. In certain embodiments, complementary oligomeric compounds or regions are complementary at 70% of the nucleobases (70% complementary). In certain embodiments, complementary oligomeric compounds or regions are 80% complementary. In certain embodiments, complementary oligomeric compounds or regions are 90% complementary. In certain embodiments, complementary oligomeric compounds or regions are 95% complementary. In certain embodiments, complementary oligomeric compounds or regions are 100% complementary.

As used herein, "mismatch" means a nucleobase of a first oligomeric compound that is not capable of pairing with a nucleobase at a corresponding position of a second oligomeric compound, when the first and second oligomeric compound are aligned. Either or both of the first and second oligomeric compounds may be oligonucleotides.

As used herein, "hybridization" means the pairing of complementary oligomeric compounds (e.g., an antisense compound and its target nucleic acid). While not limited to a particular mechanism, the most common mechanism of pairing involves hydrogen bonding, which may be Watson-Crick, Hoogsteen or reversed Hoogsteen hydrogen bonding, between complementary nucleobases.

As used herein, "specifically hybridizes" means the ability of an oligomeric compound to hybridize to one nucleic acid site with greater affinity than it hybridizes to another nucleic acid site.

As used herein, "fully complementary" in reference to an oligonucleotide or portion thereof means that each nucleobase of the oligonucleotide or portion thereof is capable of pairing with a nucleobase of a complementary nucleic acid or contiguous portion thereof. Thus, a fully complementary region comprises no mismatches or unhybridized nucleobases in either strand.

As used herein, "percent complementarity" means the percentage of nucleobases of an oligomeric compound that are complementary to an equal-length portion of a target nucleic acid. Percent complementarity is calculated by dividing the number of nucleobases of the oligomeric compound that are complementary to nucleobases at corresponding positions in the target nucleic acid by the total length of the oligomeric compound.

As used herein, "percent identity" means the number of nucleobases in a first nucleic acid that are the same type (independent of chemical modification) as nucleobases at corresponding positions in a second nucleic acid, divided by the total number of nucleobases in the first nucleic acid.

As used herein, "modulation" means a change of amount or quality of a molecule, function, or activity when compared to the amount or quality of a molecule, function, or activity prior to modulation. For example, modulation includes the change, either an increase (stimulation or induction) or a decrease (inhibition or reduction) in gene expression. As a further example, modulation of expression can include a change in splice site selection of pre-mRNA processing, resulting in a change in the absolute or relative amount of a particular splice-variant compared to the amount in the absence of modulation.

As used herein, "chemical motif" means a pattern of chemical modifications in an oligonucleotide or a region thereof. Motifs may be defined by modifications at certain nucleosides and/or at certain linking groups of an oligonucleotide.

As used herein, "nucleoside motif" means a pattern of nucleoside modifications in an oligonucleotide or a region thereof. The linkages of such an oligonucleotide may be modified or unmodified. Unless otherwise indicated, motifs herein describing only nucleosides are intended to be nucleoside motifs. Thus, in such instances, the linkages are not limited.

As used herein, "sugar motif" means a pattern of sugar modifications in an oligonucleotide or a region thereof.

As used herein, "linkage motif" means a pattern of linkage modifications in an oligonucleotide or region thereof. The nucleosides of such an oligonucleotide may be modified or unmodified. Unless otherwise indicated, motifs herein describing only linkages are intended to be linkage motifs. Thus, in such instances, the nucleosides are not limited.

As used herein, "nucleobase modification motif" means a pattern of modifications to nucleobases along an oligonucleotide. Unless otherwise indicated, a nucleobase modification motif is independent of the nucleobase sequence.

As used herein, "sequence motif" means a pattern of nucleobases arranged along an oligonucleotide or portion thereof. Unless otherwise indicated, a sequence motif is independent of chemical modifications and thus may have any combination of chemical modifications, including no chemical modifications.

As used herein, "type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

As used herein, "differently modified" mean chemical modifications or chemical substituents that are different from one another, including absence of modifications. Thus, for example, a MOE nucleoside and an unmodified DNA nucleoside are "differently modified," even though the DNA nucleoside is unmodified.

Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

As used herein, "the same type of modifications" refers to modifications that are the same as one another, including absence of modifications. Thus, for example, two unmodified DNA nucleosides have "the same type of modification," even though the DNA nucleoside is unmodified. Such nucleosides having the same type modification may comprise different nucleobases.

As used herein, "separate regions" means portions of an oligonucleotide wherein the chemical modifications or the motif of chemical modifications of any neighboring portions include at least one difference to allow the separate regions to be distinguished from one another.

As used herein, "pharmaceutically acceptable carrier or diluent" means any substance suitable for use in administering to an animal. In certain embodiments, a pharmaceutically acceptable carrier or diluent is sterile saline. In certain embodiments, such sterile saline is pharmaceutical grade saline.

As used herein the term "metabolic disorder" means a disease or condition principally characterized by dysregulation of metabolism—the complex set of chemical reactions associated with breakdown of food to produce energy.

As used herein, the term "Cardiovascular disease" or "cardiovascular disorder" means a disease or condition principally characterized by impaired function of the heart or blood vessels. Examples of cardiovascular diseases or disorders include, but are not limited to, aneurysm, angina, arrhythmia, atherosclerosis, cerebrovascular disease (stroke), coronary heart disease, hypertension, dyslipidemia, hyperlipidemia, and hypercholesterolemia.

As used herein the term "mono or polycyclic ring system" is meant to include all ring systems selected from single or polycyclic radical ring systems wherein the rings are fused or linked and is meant to be inclusive of single and mixed ring systems individually selected from aliphatic, alicyclic, aryl, heteroaryl, aralkyl, arylalkyl, heterocyclic, heteroaryl, heteroaromatic and heteroarylalkyl. Such mono and poly cyclic structures can contain rings that each have the same level of saturation or each, independently, have varying degrees of saturation including fully saturated, partially saturated or fully unsaturated. Each ring can comprise ring atoms selected from C, N, O and S to give rise to heterocyclic rings as well as rings comprising only C ring atoms which can be present in a mixed motif such as for example benzimidazole wherein one ring has only carbon ring atoms and the fused ring has two nitrogen atoms. The mono or polycyclic ring system can be further substituted with substituent groups such as for example phthalimide which has two =O groups attached to one of the rings. Mono or polycyclic ring systems can be attached to parent molecules using various strategies such as directly through a ring atom, fused through multiple ring atoms, through a substituent group or through a bifunctional linking moiety.

As used herein, "prodrug" means an inactive or less active form of a compound which, when administered to a subject, is metabolized to form the active, or more active, compound (e.g., drug).

As used herein, "substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substitutent is any atom or group at the 2'-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as an alkyl or hydrocarbyl group to a parent compound.

Likewise, as used herein, "substituent" in reference to a chemical functional group means an atom or group of atoms that differs from the atom or a group of atoms normally present in the named functional group. In certain embodiments, a substituent replaces a hydrogen atom of the functional group (e.g., in certain embodiments, the substituent of a substituted methyl group is an atom or group other than hydrogen which replaces one of the hydrogen atoms of an unsubstituted methyl group). Unless otherwise indicated, groups amenable for use as substituents include without limitation, halogen, hydroxyl, alkyl, alkenyl, alkynyl, acyl (—C(O)$R_{aa}$), carboxyl (—C(O)O—$R_{aa}$), aliphatic groups, alicyclic groups, alkoxy, substituted oxy (—O—$R_{aa}$), aryl, aralkyl, heterocyclic radical, heteroaryl, heteroarylalkyl, amino (—N($R_{bb}$)($R_{cc}$)), imino(=$NR_{bb}$), amido (—C(O)N($R_{bb}$)($R_{cc}$) or —N($R_{bb}$)C(O)$R_{aa}$), azido (—$N_3$), nitro (—$NO_2$), cyano (—CN), carbamido (—OC(O)N($R_{bb}$)($R_{cc}$) or —N($R_{bb}$)C(O)O$R_{aa}$), ureido (—N($R_{bb}$)C(O)N($R_{bb}$)($R_{cc}$)), thioureido (—N($R_{bb}$)C(S)N($R_{bb}$)—($R_{cc}$)), guanidinyl (—N($R_{bb}$)C(=$NR_{bb}$)N($R_{bb}$)($R_{cc}$)), amidinyl (—C(=$NR_{bb}$)N($R_{bb}$)($R_{cc}$) or —N($R_{bb}$)C(=$NR_{bb}$)($R_{aa}$)), thiol (—$SR_{bb}$), sulfinyl (—S(O)$R_{bb}$), sulfonyl (—S(O)$_2R_{bb}$) and sulfonamidyl (—S(O)$_2$N($R_{bb}$)($R_{cc}$) or —N($R_{bb}$)S—(O)$_2R_{bb}$). Wherein each $R_{aa}$, $R_{bb}$ and $R_{cc}$ is, independently, H, an optionally linked chemical functional group or a further substituent group with a preferred list including without limitation, alkyl, alkenyl, alkynyl, aliphatic, alkoxy, acyl, aryl, aralkyl, heteroaryl, alicyclic, heterocyclic and heteroarylalkyl. Selected substituents within the compounds described herein are present to a recursive degree.

As used herein, "alkyl," as used herein, means a saturated straight or branched hydrocarbon radical containing up to twenty four carbon atoms. Examples of alkyl groups include without limitation, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms ($C_1$-$C_{12}$ alkyl) with from 1 to about 6 carbon atoms being more preferred.

As used herein, "alkenyl," means a straight or branched hydrocarbon chain radical containing up to twenty four carbon atoms and having at least one carbon-carbon double bond. Examples of alkenyl groups include without limitation, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

As used herein, "alkynyl," means a straight or branched hydrocarbon radical containing up to twenty four carbon atoms and having at least one carbon-carbon triple bond. Examples of alkynyl groups include, without limitation, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

As used herein, "acyl," means a radical formed by removal of a hydroxyl group from an organic acid and has the general Formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substituent groups.

As used herein, "alicyclic" means a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

As used herein, "aliphatic" means a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation, polyalkoxys, such as polyalkylene glycols, polyamines, and polyimines. Aliphatic groups as used herein may optionally include further substituent groups.

As used herein, "alkoxy" means a radical formed between an alkyl group and an oxygen atom wherein the oxygen atom is used to attach the alkoxy group to a parent molecule. Examples of alkoxy groups include without limitation, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substituent groups.

As used herein, "aminoalkyl" means an amino substituted $C_1$-$C_{12}$ alkyl radical. The alkyl portion of the radical forms a covalent bond with a parent molecule. The amino group can be located at any position and the aminoalkyl group can be substituted with a further substituent group at the alkyl and/or amino portions.

As used herein, "aralkyl" and "arylalkyl" mean an aromatic group that is covalently linked to a $C_1$-$C_{12}$ alkyl radical. The alkyl radical portion of the resulting aralkyl (or arylalkyl) group forms a covalent bond with a parent molecule. Examples include without limitation, benzyl, phenethyl and the like. Aralkyl groups as used herein may optionally include further substituent groups attached to the alkyl, the aryl or both groups that form the radical group.

As used herein, "aryl" and "aromatic" mean a mono- or polycyclic carbocyclic ring system radicals having one or more aromatic rings. Examples of aryl groups include without limitation, phenyl, naphthyl, tetrahydronaphthyl, indanyl, idenyl and the like. Preferred aryl ring systems have from about 5 to about 20 carbon atoms in one or more rings. Aryl groups as used herein may optionally include further substituent groups.

As used herein, "halo" and "halogen," mean an atom selected from fluorine, chlorine, bromine and iodine.

As used herein, "heteroaryl," and "heteroaromatic," mean a radical comprising a mono- or polycyclic aromatic ring, ring system or fused ring system wherein at least one of the rings is aromatic and includes one or more heteroatoms. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include without limitation, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl and the like. Heteroaryl radicals can be attached to a parent molecule directly or through a linking moiety such as an aliphatic group or hetero atom. Heteroaryl groups as used herein may optionally include further substituent groups.

As used herein, "conjugate compound" means any atoms, group of atoms, or group of linked atoms suitable for use as a conjugate group. In certain embodiments, conjugate compounds may possess or impart one or more properties, including, but not limited to pharmacodynamic, pharmacokinetic, binding, absorption, cellular distribution, cellular uptake, charge and/or clearance properties.

As used herein, unless otherwise indicated or modified, the term "double-stranded" refers to two separate oligomeric compounds that are hybridized to one another. Such double stranded compounds may have one or more or non-hybridizing nucleosides at one or both ends of one or both strands (overhangs) and/or one or more internal non-hybridizing nucleosides (mismatches) provided there is sufficient complementarity to maintain hybridization under physiologically relevant conditions.

As used herein, "2'-O-methoxyethyl" (also 2'-MOE and 2'-O(CH$_2$)$_2$—OCH$_3$) refers to an O-methoxyethyl modification of the 2' position of a furosyl ring. A 2'-O-methoxyethyl modified sugar is a modified sugar.

As used herein, "2'-O-methoxyethyl nucleotide" means a nucleotide comprising a 2'-O-methoxyethyl modified sugar moiety.

"3' target site" or "3' stop site" refers to the nucleotide of a target nucleic acid which is complementary to the 3'-most nucleotide of a particular antisense compound.

As used herein, "5' target site" or "5 start site" refers to the nucleotide of a target nucleic acid which is complementary to the 5'-most nucleotide of a particular antisense compound.

As used herein, "5-methylcytosine" means a cytosine modified with a methyl group attached to the 5' position. A 5-methylcytosine is a modified nucleobase.

As used herein, "about" means within ±10% of a value. For example, if it is stated, "a marker may be increased by about 50%", it is implied that the marker may be increased between 45%-55%

As used herein, "active pharmaceutical agent" means the substance or substances in a pharmaceutical composition that provide a therapeutic benefit when administered to an individual. For example, in certain embodiments an antisense oligonucleotide targeted to ANGPTL3 is an active pharmaceutical agent.

As used herein, "active target region" or "target region" means a region to which one or more active antisense compounds is targeted.

As used herein, "active antisense compounds" means antisense compounds that reduce target nucleic acid levels or protein levels.

As used herein, "adipogenesis" means the development of fat cells from preadipocytes. "Lipogenesis" means the production or formation of fat, either fatty degeneration or fatty infiltration.

As used herein, "adiposity" or "obesity" refers to the state of being obese or an excessively high amount of body fat or adipose tissue in relation to lean body mass. The amount of body fat includes concern for both the distribution of fat throughout the body and the size and mass of the adipose tissue deposits. Body fat distribution can be estimated by skin-fold measures, waist-to-hip circumference ratios, or techniques such as ultrasound, computed tomography, or magnetic resonance imaging. According to the Center for Disease Control and Prevention, individuals with a body mass index (BMI) of 30 or more are considered obese. The term "Obesity" as used herein includes conditions where there is an increase in body fat beyond the physical requirement as a result of excess accumulation of adipose tissue in the body. The term "obesity" includes, but is not limited to, the following conditions: adult-onset obesity; alimentary obesity; endogenous or metabolic obesity; endocrine obesity; familial obesity; hyperinsulinar obesity; hyperplastic-hypertrophic obesity; hypogonadal obesity; hypothyroid obesity; lifelong obesity; morbid obesity and exogenous obesity.

As used herein, "administered concomitantly" refers to the co-administration of two agents in any manner in which the pharmacological effects of both are manifest in the patient at the same time. Concomitant administration does not require that both agents be administered in a single pharmaceutical composition, in the same dosage form, or by the same route of administration. The effects of both agents need not manifest themselves at the same time. The effects need only be overlapping for a period of time and need not be coextensive.

As used herein, "administering" means providing an agent to an animal, and includes, but is not limited to, administering by a medical professional and self-administering.

As used herein, "agent" means an active substance that can provide a therapeutic benefit when administered to an animal. "First Agent" means a therapeutic compound of the invention. For example, a first agent can be an antisense oligonucleotide targeting ANGPTL3. "Second agent" means a second therapeutic compound of the invention (e.g. a second antisense oligonucleotide targeting ANGPTL3) and/or a non-ANGPTL3 therapeutic compound.

As used herein, "amelioration" refers to a lessening of at least one indicator, sign, or symptom of an associated disease, disorder, or condition. The severity of indicators can be determined by subjective or objective measures, which are known to those skilled in the art.

As used herein, "ANGPTL3" means any nucleic acid or protein of ANGPTL3.

As used herein, "ANGPTL3 expression" means the level of mRNA transcribed from the gene encoding ANGPTL3 or the level of protein translated from the mRNA. ANGPTL3 expression can be determined by art known methods such as a Northern or Western blot.

As used herein, "ANGPTL3 nucleic acid" means any nucleic acid encoding ANGPTL3. For example, in certain embodiments, an ANGPTL3 nucleic acid includes a DNA sequence encoding ANGPTL3, a RNA sequence transcribed from DNA encoding ANGPTL3 (including genomic DNA comprising introns and exons), and a mRNA sequence encoding ANGPTL3. "ANGPTL3 mRNA" means a mRNA encoding an ANGPTL3 protein.

As used herein, "animal" refers to a human or non-human animal, including, but not limited to, mice, rats, rabbits, dogs, cats, pigs, and non-human primates, including, but not limited to, monkeys and chimpanzees.

As used herein, "apoB-containing lipoprotein" means any lipoprotein that has apolipoprotein B as its protein component, and is understood to include LDL, VLDL, IDL, and lipoprotein(a) and can be generally targeted by lipid lowering agent and therapies. "ApoB-100-containing LDL" means ApoB-100 isoform containing LDL.

As used herein, "atherosclerosis" means a hardening of the arteries affecting large and medium-sized arteries and is characterized by the presence of fatty deposits. The fatty deposits are called "atheromas" or "plaques," which consist mainly of cholesterol and other fats, calcium and scar tissue, and damage the lining of arteries.

As used herein, "cardiometabolic disease" or "cardiometabolic disorder" are diseases or disorders concerning both the cardiovascular system and the metabolic system. Examples of cardiometabolic diseases or disorders include, but are not limited to, diabetes and dyslipidemias.

As used herein, "co-administration" means administration of two or more agents to an individual. The two or more agents can be in a single pharmaceutical composition, or can be in separate pharmaceutical compositions. Each of the two or more agents can be administered through the same or different routes of administration. Co-administration encompasses parallel or sequential administration.

As used herein, "cholesterol" is a sterol molecule found in the cell membranes of all animal tissues. Cholesterol must be transported in an animal's blood plasma by lipoproteins including very low density lipoprotein (VLDL), intermediate density lipoprotein (IDL), low density lipoprotein (LDL), and high density lipoprotein (HDL). "Plasma cholesterol" refers to the sum of all lipoproteins (VDL, IDL, LDL, HDL) esterified and/or non-estrified cholesterol present in the plasma or serum.

As used herein, "cholesterol absorption inhibitor" means an agent that inhibits the absorption of exogenous cholesterol obtained from diet.

As used herein, "coronary heart disease (CHD)" means a narrowing of the small blood vessels that supply blood and oxygen to the heart, which is often a result of atherosclerosis.

As used herein, "diabetes mellitus" or "diabetes" is a syndrome characterized by disordered metabolism and abnormally high blood sugar (hyperglycemia) resulting from insufficient levels of insulin or reduced insulin sensitivity. The characteristic symptoms are excessive urine production (polyuria) due to high blood glucose levels, excessive thirst and increased fluid intake (polydipsia) attempting to compensate for increased urination, blurred vision due to high blood glucose effects on the eye's optics, unexplained weight loss, and lethargy.

As used herein, "diabetic dyslipidemia" or "type 2 diabetes with dyslipidemia" means a condition characterized by Type 2 diabetes, reduced HDL-C, elevated triglycerides, and elevated small, dense LDL particles.

As used herein, "diluent" means an ingredient in a composition that lacks pharmacological activity, but is pharmaceutically necessary or desirable. For example, the diluent in an injected composition can be a liquid, e.g. saline solution.

As used herein, "dyslipidemia" refers to a disorder of lipid and/or lipoprotein metabolism, including lipid and/or lipoprotein overproduction or deficiency. Dyslipidemias may be manifested by elevation of lipids such as cholesterol and triglycerides as well as lipoproteins such as low-density lipoprotein (LDL) cholesterol.

As used herein, "dosage unit" means a form in which a pharmaceutical agent is provided, e.g. pill, tablet, or other dosage unit known in the art. In certain embodiments, a dosage unit is a vial containing lyophilized antisense oligonucleotide. In certain embodiments, a dosage unit is a vial containing reconstituted antisense oligonucleotide.

As used herein, "dose" means a specified quantity of a pharmaceutical agent provided in a single administration, or in a specified time period. In certain embodiments, a dose can be administered in one, two, or more boluses, tablets, or injections. For example, in certain embodiments where subcutaneous administration is desired, the desired dose requires a volume not easily accommodated by a single injection, therefore, two or more injections can be used to achieve the desired dose. In certain embodiments, the pharmaceutical agent is administered by infusion over an extended period of time or continuously. Doses can be stated as the amount of pharmaceutical agent per hour, day, week, or month. Doses can be expressed as mg/kg or g/kg.

As used herein, "effective amount" or "therapeutically effective amount" means the amount of active pharmaceutical agent sufficient to effectuate a desired physiological outcome in an individual in need of the agent. The effective amount can vary among individuals depending on the health and physical condition of the individual to be treated, the taxonomic group of the individuals to be treated, the formulation of the composition, assessment of the individual's medical condition, and other relevant factors.

As used herein, "glucose" is a monosaccharide used by cells as a source of energy and metabolic intermediate. "Plasma glucose" refers to glucose present in the plasma.

As used herein, "high density lipoprotein-C(HDL-C)" means cholesterol associated with high density lipoprotein particles. Concentration of HDL-C in serum (or plasma) is typically quantified in mg/dL or nmol/L. "serum HDL-C" and "plasma HDL-C" mean HDL-C in serum and plasma, respectively.

As used herein, "HMG-CoA reductase inhibitor" means an agent that acts through the inhibition of the enzyme HMG-CoA reductase, such as atorvastatin, rosuvastatin, fluvastatin, lovastatin, pravastatin, and simvastatin.

As used herein, "hypercholesterolemia" means a condition characterized by elevated cholesterol or circulating (plasma) cholesterol, LDL-cholesterol and VLDL-cholesterol, as per the guidelines of the Expert Panel Report of the National Cholesterol Educational Program (NCEP) of Detection, Evaluation of Treatment of high cholesterol in adults (see, Arch. Int. Med. (1988) 148, 36-39).

As used herein, "hyperlipidemia" or "hyperlipemia" is a condition characterized by elevated serum lipids or circulating (plasma) lipids. This condition manifests an abnormally high concentration of fats. The lipid fractions in the circulating blood are cholesterol, low density lipoproteins, very low density lipoproteins and triglycerides.

As used herein, "hypertriglyceridemia" means a condition characterized by elevated triglyceride levels.

As used herein, "identifying" or "selecting a subject having a metabolic or cardiovascular disease" means identifying or selecting a subject having been diagnosed with a metabolic disease, a cardiovascular disease, or a metabolic syndrome; or, identifying or selecting a subject having any symptom of a metabolic disease, cardiovascular disease, or metabolic syndrome including, but not limited to, hypercholesterolemia, hyperglycemia, hyperlipidemia, hypertriglyceridemia, hypertension, increased insulin resistance, decreased insulin sensitivity, above normal body weight, and/or above normal body fat content or any combination thereof. Such identification may be accomplished by any method, including but not limited to, standard clinical tests or assessments, such as measuring serum or circulating (plasma) cholesterol, measuring serum or circulating (plasma) blood-glucose, measuring serum or circulating (plasma) triglycerides, measuring blood-pressure, measuring body fat content, measuring body weight, and the like.

As used herein, "identifying" or "selecting a diabetic subject" means identifying or selecting a subject having been identified as diabetic or identifying or selecting a subject having any symptom of diabetes (type 1 or type 2) such as, but not limited to, having a fasting glucose of at least 110 mg/dL, glycosuria, polyuria, polydipsia, increased insulin resistance, and/or decreased insulin sensitivity.

As used herein, "identifying" or "selecting an obese subject" means identifying or selecting a subject having been diagnosed as obese or identifying or selecting a subject with a BMI over 30 and/or a waist circumference of greater than 102 cm in men or greater than 88 cm in women.

As used herein, "identifying" or "selecting a subject having dyslipidemia" means identifying or selecting a subject diagnosed with a disorder of lipid and/or lipoprotein metabolism, including lipid and/or lipoprotein overproduction or deficiency. Dyslipidemias may be manifested by elevation of lipids such as cholesterol and triglycerides as well as lipoproteins such as low-density lipoprotein (LDL) cholesterol.

As used herein, "identifying" or "selecting" a subject having increased adiposity" means identifying or selecting a subject having an increased amount of body fat (or adiposity) that includes concern for one or both the distribution of fat throughout the body and the size and mass of the adipose tissue deposits. Body fat distribution can be estimated by skin-fold measures, waist-to-hip circumference ratios, or techniques such as ultrasound, computer tomography, or magnetic resonance imaging. According to the Center for Disease Control and Prevention, individuals with a body mass index (BMI) of 30 or more are considered obese.

As used herein, "improved cardiovascular outcome" means a reduction in the occurrence of adverse cardiovascular events, or the risk thereof. Examples of adverse cardiovascular events include, without limitation, death, reinfarction, stroke, cardiogenic shock, pulmonary edema, cardiac arrest, and atrial dysrhythmia.

As used herein, "immediately adjacent" means there are no intervening elements between the immediately adjacent elements.

As used herein, "individual" or "subject" or "animal" means a human or non-human animal selected for treatment or therapy.

As used herein, "insulin resistance" is defined as the condition in which normal amounts of insulin are inadequate to produce a normal insulin response from cells, e.g., fat, muscle and/or liver cells. Insulin resistance in fat cells results in hydrolysis of stored triglycerides, which elevates free fatty acids in the blood plasma. Insulin resistance in muscle reduces glucose uptake whereas insulin resistance in liver reduces glucose storage, with both effects serving to elevate blood glucose. High plasma levels of insulin and glucose due to insulin resistance often leads to metabolic syndrome and type 2 diabetes.

As used herein, "insulin sensitivity" is a measure of how effectively an individual processes glucose. An individual having high insulin sensitivity effectively processes glucose whereas an individual with low insulin sensitivity does not effectively process glucose.

As used herein, "intravenous administration" means administration into a vein.

As used herein, "lipid-lowering" means a reduction in one or more lipids in a subject. Lipid-lowering can occur with one or more doses over time.

As used herein, "lipid-lowering agent" means an agent, for example, an ANGPTL3-specific modulator, provided to a subject to achieve a lowering of lipids in the subject. For example, in certain embodiments, a lipid-lowering agent is provided to a subject to reduce one or more of apoB, apoC-III, total cholesterol, LDL-C, VLDL-C, IDL-C, non-HDL-C, triglycerides, small dense LDL particles, and Lp(a) in a subject.

As used herein, "lipid-lowering therapy" means a therapeutic regimen provided to a subject to reduce one or more lipids in a subject. In certain embodiments, a lipid-lowering therapy is provided to reduce one or more of apoB, apoC-III, total cholesterol, LDL-C, VLDL-C, IDL-C, non-HDL-C, triglycerides, small dense LDL particles, and Lp(a) in a subject.

As used herein, "lipoprotein", such as VLDL, LDL and HDL, refers to a group of proteins found in the serum, plasma and lymph and are important for lipid transport. The chemical composition of each lipoprotein differs in that the HDL has a higher proportion of protein versus lipid, whereas the VLDL has a lower proportion of protein versus lipid.

As used herein, "low density lipoprotein-cholesterol (LDL-C)" means cholesterol carried in low density lipoprotein particles. Concentration of LDL-C in serum (or plasma) is typically quantified in mg/dL or nmol/L. "Serum LDL-C" and "plasma LDL-C" mean LDL-C in the serum and plasma, respectively.

As used herein, "major risk factors" refers to factors that contribute to a high risk for a particular disease or condition. In certain embodiments, major risk factors for coronary heart disease include, without limitation, cigarette smoking, hypertension, low HDL-C, family history of coronary heart disease, age, and other factors disclosed herein.

As used herein, "metabolic disorder" or "metabolic disease" refers to a condition characterized by an alteration or disturbance in metabolic function. "Metabolic" and "metabolism" are terms well known in the art and generally include the whole range of biochemical processes that occur within a living organism. Metabolic disorders include, but are not limited to, hyperglycemia, prediabetes, diabetes (type I and type 2), obesity, insulin resistance, metabolic syndrome and dyslipidemia due to type 2 diabetes.

As used herein, "metabolic syndrome" means a condition characterized by a clustering of lipid and non-lipid cardiovascular risk factors of metabolic origin. In certain embodiments, metabolic syndrome is identified by the presence of any 3 of the following factors: waist circumference of greater than 102 cm in men or greater than 88 cm in women; serum triglyceride of at least 150 mg/dL; HDL-C less than 40 mg/dL in men or less than 50 mg/dL in women; blood pressure of at least 130/85 mmHg; and fasting glucose of at least 110 mg/dL. These determinants can be readily measured in clinical practice (JAMA, 2001, 285: 2486-2497).

As used herein, "mixed dyslipidemia" means a condition characterized by elevated cholesterol and elevated triglycerides.

As used herein, "MTP inhibitor" means an agent inhibits the enzyme microsomal triglyceride transfer protein.

As used herein, "non-alcoholic fatty liver disease" or "NAFLD" means a condition characterized by fatty inflammation of the liver that is not due to excessive alcohol use (for example, alcohol consumption of over 20 g/day). In certain embodiments, NAFLD is related to insulin resistance and metabolic syndrome. NAFLD encompasses a disease spectrum ranging from simple triglyceride accumulation in hepatocytes (hepatic steatosis) to hepatic steatosis with inflammation (steatohepatitis), fibrosis, and cirrhosis.

As used herein, "nonalcoholic steatohepatitis" (NASH) occurs from progression of NAFLD beyond deposition of triglycerides. A "second hit" capable of inducing necrosis, inflammation, and fibrosis is required for development of NASH. Candidates for the second-hit can be grouped into broad categories: factors causing an increase in oxidative stress and factors promoting expression of proinflammatory cytokines. It has been suggested that increased liver triglycerides lead to increased oxidative stress in hepatocytes of animals and humans, indicating a potential cause-and-effect relationship between hepatic triglyceride accumulation, oxidative stress, and the progression of hepatic steatosis to NASH (Browning and Horton, *J Clin Invest,* 2004, 114, 147-152). Hypertriglyceridemia and hyperfattyacidemia can cause triglyceride accumulation in peripheral tissues (Shimamura et al., *Biochem Biophys Res Commun,* 2004, 322, 1080-1085).

As used herein, "nucleic acid" refers to molecules composed of monomeric nucleotides. A nucleic acid includes ribonucleic acids (RNA), deoxyribonucleic acids (DNA), single-stranded nucleic acids, double-stranded nucleic acids, small interfering ribonucleic acids (siRNA), and microRNAs (miRNA). A nucleic acid can also comprise a combination of these elements in a single molecule.

As used herein, "parenteral administration" means administration by a manner other than through the digestive tract. Parenteral administration includes topical administration, subcutaneous administration, intravenous administration, intramuscular administration, intraarterial administration, intraperitoneal administration, or intracranial administration, e.g. intrathecal or intracerebroventricular administration. Administration can be continuous, or chronic, or short or intermittent.

As used herein, "pharmaceutical agent" means a substance that provides a therapeutic benefit when administered to an individual. For example, in certain embodiments, an antisense oligonucleotide targeted to ANGPTL3 is pharmaceutical agent.

As used herein, "pharmaceutical composition" means a mixture of substances suitable for administering to an individual. For example, a pharmaceutical composition can comprise one or more active agents and a sterile aqueous solution.

As used herein, "pharmaceutically acceptable carrier" means a medium or diluent that does not interfere with the structure or function of the oligonucleotide. Certain, of such carries enable pharmaceutical compositions to be formulated as, for example, tablets, pills, dragees, capsules, liquids, gels, syrups, slurries, suspension and lozenges for the oral ingestion by a subject. Certain of such carriers enable pharmaceutical compositions to be formulated for injection or infusion. For example, a pharmaceutically acceptable carrier can be a sterile aqueous solution.

As used herein, "pharmaceutically acceptable salts" means physiologically and pharmaceutically acceptable salts of antisense compounds, i.e., salts that retain the desired biological activity of the parent oligonucleotide and do not impart undesired toxicological effects thereto.

As used herein, "portion" means a defined number of contiguous (i.e. linked) nucleobases of a nucleic acid. In certain embodiments, a portion is a defined number of contiguous nucleobases of a target nucleic acid. In certain embodiments, a portion is a defined number of contiguous nucleobases of an antisense compound.

As used herein, "prevent" refers to delaying or forestalling the onset or development of a disease, disorder, or condition for a period of time from minutes to indefinitely. Prevent also means reducing risk of developing a disease, disorder, or condition.

As used herein, "side effects" means physiological responses attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum can indicate liver toxicity or liver function abnormality. For example, increased bilirubin can indicate liver toxicity or liver function abnormality.

As used herein, "statin" means an agent that inhibits the activity of HMG-CoA reductase.

As used herein, "subcutaneous administration" means administration just below the skin.

As used herein, "targeting" or "targeted" means the process of design and selection of an antisense compound that will specifically hybridize to a target nucleic acid and induce a desired effect.

As used herein, "target nucleic acid," "target RNA," and "target RNA transcript" all refer to a nucleic acid capable of being targeted by antisense compounds.

As used herein, "target region" is defined as a portion of the target nucleic acid having at least one identifiable structure, function, or characteristic.

As used herein, "target segment" means the sequence of nucleotides of a target nucleic acid to which one or more antisense compound is targeted. "5' target site" or "5' start site" refers to the 5'-most nucleotide of a target segment. "3' target site" or "3' stop site" refers to the 3'-most nucleotide of a target segment. As used herein, "therapeutically effective amount" means an amount of an agent that provides a therapeutic benefit to an individual.

As used herein, "therapeutic lifestyle change" means dietary and lifestyle changes intended to lower fat/adipose tissue mass and/or cholesterol. Such change can reduce the risk of developing heart disease, and may include recommendations for dietary intake of total daily calories, total fat, saturated fat, polyunsaturated fat, monounsaturated fat, carbohydrate, protein, cholesterol, insoluble fiber, as well as recommendations for physical activity.

As used herein, "triglyceride" means a lipid or neutral fat consisting of glycerol combined with three fatty acid molecules.

As used herein, "type 2 diabetes" (also known as "type 2 diabetes mellitus" or "diabetes mellitus, type 2", and formerly called "diabetes mellitus type 2", "non-insulin-dependent diabetes (NIDDM)", "obesity related diabetes", or "adult-onset diabetes") is a metabolic disorder that is primarily characterized by insulin resistance, relative insulin deficiency, and hyperglycemia.

As used herein, "treat" refers to administering a pharmaceutical composition to effect an alteration or improvement of a disease, disorder, or condition.

Certain Embodiments

In certain embodiments disclosed herein, ANGPTL3 has the sequence as set forth in GenBank Accession No. NM_014495.2 (incorporated herein as SEQ ID NO: 1). In certain embodiments, ANGPTL3 has the sequence as set forth in GenBank Accession No. NT_032977.9 nucleotides 33032001 to 33046000 (incorporated herein as SEQ ID NO: 2).

Certain embodiments disclosed herein provide compounds or compositions comprising a modified oligonucleotide and a conjugate group, wherein the modified oligonucleotide consists of 12 to 30 nucleosides having a nucleobase sequence comprising at least 8 contiguous nucleobases complementary to an equal length portion of SEQ ID NOs: 1-2.

In certain embodiments, a compound comprises a siRNA or antisense oligonucleotide targeted to ANGPTL3 known in the art and a conjugate group described herein. Examples of antisense oligonucleotides targeted to ANGPTL3 suitable for conjugation include but are not limited to those disclosed in U.S. Pat. No. 8,653,047 (WO 2011/085271), which is incorporated by reference in its entirety herein. In certain embodiments, a compound comprises an antisense oligonucleotide having a nucleobase sequence of any of SEQ ID NOs: 34-111 disclosed in U.S. Pat. No. 8,653,047 and a conjugate group described herein. In certain embodiments, a compound comprises a siRNA sense or antisense strand having a nucleobase sequence of any of SEQ ID NOs: 34-111 disclosed in U.S. Pat. No. 8,653,047 and a conjugate group described herein. The nucleobase sequences of all of the aforementioned referenced SEQ ID NOs are incorporated by reference herein.

Certain embodiments disclosed herein provide compounds or compositions comprising a modified oligonucleotide and a conjugate group, wherein the modified oligonucleotide consists of 12 to 30 linked nucleosides in length targeted to ANGPTL3. The ANGPTL3 target can have a sequence selected from any one of SEQ ID NOs: 1-2.

Certain embodiments disclosed herein provide compounds or compositions comprising a modified oligonucleotide and a conjugate group, wherein the modified oligonucleotide consists of 12 to 30 linked nucleosides and comprising a nucleobase sequence comprising a portion of at least 8 contiguous nucleobases complementary to an equal length portion of nucleobases 1140 to 1159 of SEQ ID NO: 1, wherein the nucleobase sequence of the modified oligonucleotide is at least 80% complementary to SEQ ID NO: 1. In certain embodiments, the modified oligonucleotide is at least 8, least 9, least 10, least 11, at least 12, least 13, at least 14, at least 15, at least 16, least 17, least 18, least 19, or 20 contiguous nucleobases complementary to an equal length portion of nucleobases 1140 to 1159 of SEQ ID NO: 1.

Certain embodiments disclosed herein provide compounds or compositions comprising a modified oligonucleotide and a conjugate group, wherein the modified oligonucleotide consists of 12 to 30 linked nucleosides and comprising a nucleobase sequence complementary to nucleobases 1140 to 1159 of SEQ ID NO: 1, wherein the nucleobase sequence of the modified oligonucleotide is at least 80% complementary to SEQ ID NO: 1.

Certain embodiments disclosed herein provide compounds or compositions comprising a modified oligonucleotide and a conjugate group, wherein the modified oligonucleotide consists of 12 to 30 linked nucleosides and comprising a nucleobase sequence comprising a portion of at least 8 contiguous nucleobases complementary to an equal length portion of nucleobases 1907 to 1926 of SEQ ID NO: 1, wherein the nucleobase sequence of the modified oligonucleotide is at least 80% complementary to SEQ ID NO: 1. In certain embodiments, the modified oligonucleotide is at least 8, least 9, least 10, least 11, at least 12, least 13, at least 14, at least 15, at least 16, least 17, least 18, least 19, or 20 contiguous nucleobases complementary to an equal length portion of nucleobases 1907 to 1926 of SEQ ID NO: 1.

Certain embodiments disclosed herein provide compounds or compositions comprising a modified oligonucleotide and a conjugate group, wherein the modified oligonucleotide consists of 12 to 30 linked nucleosides and comprising a nucleobase sequence complementary to nucleobases 1907 to 1926 of SEQ ID NO: 1, wherein the nucleobase sequence of the modified oligonucleotide is at least 80% complementary to SEQ ID NO: 1.

Certain embodiments disclosed herein provide compounds or compositions comprising a modified oligonucleotide and a conjugate group, wherein the modified oligonucleotide consists of 12 to 30 linked nucleosides and comprising a nucleobase sequence comprising a portion of at least 8 contiguous nucleobases complementary to an equal length portion of nucleobases 147 to 162 of SEQ ID NO: 1, wherein the nucleobase sequence of the modified oligonucleotide is at least 80% complementary to SEQ ID NO: 1. In certain embodiments, the modified oligonucleotide is at least 8, least 9, least 10, least 11, at least 12, least 13, at least 14, at least 15, or 16 contiguous nucleobases complementary to an equal length portion of nucleobases 147 to 162 of SEQ ID NO: 1.

Certain embodiments disclosed herein provide compounds or compositions comprising a modified oligonucleotide and a conjugate group, wherein the modified oligonucleotide consists of 12 to 30 linked nucleosides and comprising a nucleobase sequence complementary to nucleobases 147 to 162 of SEQ ID NO: 1, wherein the nucleobase sequence of the modified oligonucleotide is at least 80% complementary to SEQ ID NO: 1.

In certain embodiments, the modified oligonucleotide consists of 12 to 30, 15 to 30, 18 to 24, 19 to 22, 13 to 25, 14 to 25, 15 to 25 or 16 to 24 linked nucleosides. In certain embodiments, the modified oligonucleotide consists of 8, 9, 10, 11, 12, 13, 14, 15, 16, 17, 18, 19, 20, 21, 22, 23, 24, 25, 26, 27, 28, 29 or 30 linked nucleosides or a range defined by any two of these values. In certain embodiments, the modified oligonucleotide is 16 linked nucleosides in length. In certain embodiments, the modified oligonucleotide is 20 linked nucleosides in length.

In certain embodiments, the modified oligonucleotide comprises a nucleobase sequence comprising a portion of at least 8, least 9, least 10, least 11, at least 12, least 13, at least 14, at least 15, at least 16, least 17, least 18, least 19, or 20 contiguous nucleobases complementary to an equal length portion of SEQ ID NO: 1 or 2.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, least 9, least 10, least 11, at least 12, least 13, at least 14, at least 15, at least 16, least 17, least 18, least 19, or 20 contiguous nucleobases of a nucleobase sequence selected from any one of SEQ ID NOs: 15-27, 30-73, 75-85, 87-232, 238, 240-243, 245-247, 249-262, 264-397, 399-469, 471-541, 543-600, 604-760, 762-819, 821-966, 968-971, 973-975, 977-990, 992-1110, 1112-1186, 1188-1216, 1218-1226, 1228-1279, 1281-1293, 1295-1304, 1306-1943, 1945-1951, 1953-1977, 1979-1981, 1983-2044, 2046-2097, 2099-2181, 2183-2232, 2234-2238, 2240-2258, 2260-2265, 2267-2971, 2973-2976, 2978-4162, 4164-4329, 4331-4389, 4391-4394, 4396-4877.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of the nucleobase sequences of SEQ ID NO: 77. In certain embodiments, the compound comprises ISIS 563580 and a conjugate group. In certain embodiments, the compound consists of ISIS 563580 and a conjugate group.

In certain embodiments, the present disclosure provides conjugated antisense compounds represented by the following structure. In certain embodiments, the antisense compound comprises the modified oligonucleotide ISIS 563580 with a 5'-X, wherein X is a conjugate group comprising GalNAc. In certain embodiments, the antisense compound consists of the modified oligonucleotide ISIS 563580 with a 5'-X, wherein X is a conjugate group comprising GalNAc.

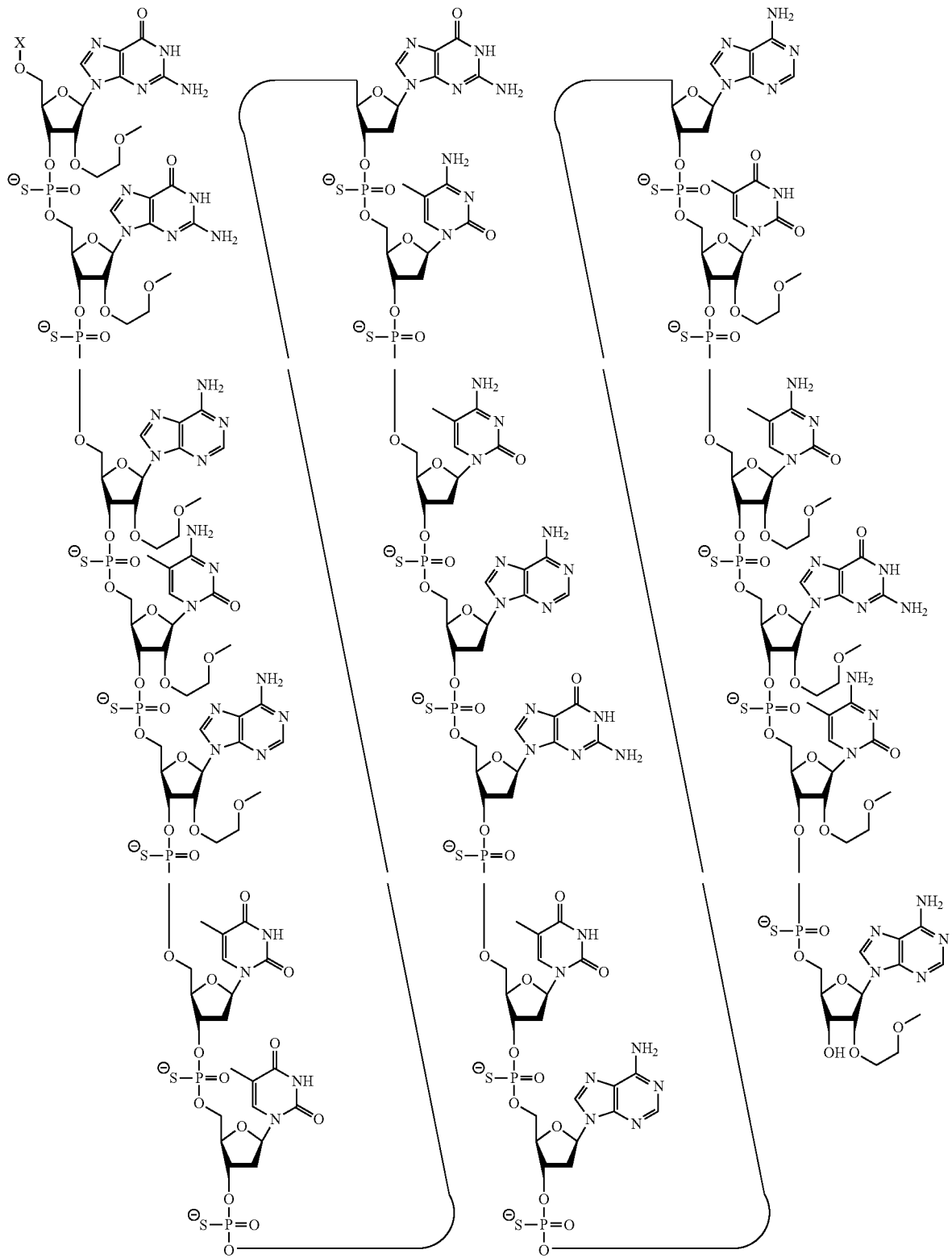

In certain embodiments, the present disclosure provides conjugated antisense compounds represented by the following structure. In certain embodiments, the antisense compound comprises the conjugated modified oligonucleotide ISIS 703801. In certain embodiments, the antisense compound consists of the conjugated modified oligonucleotide ISIS 703801.
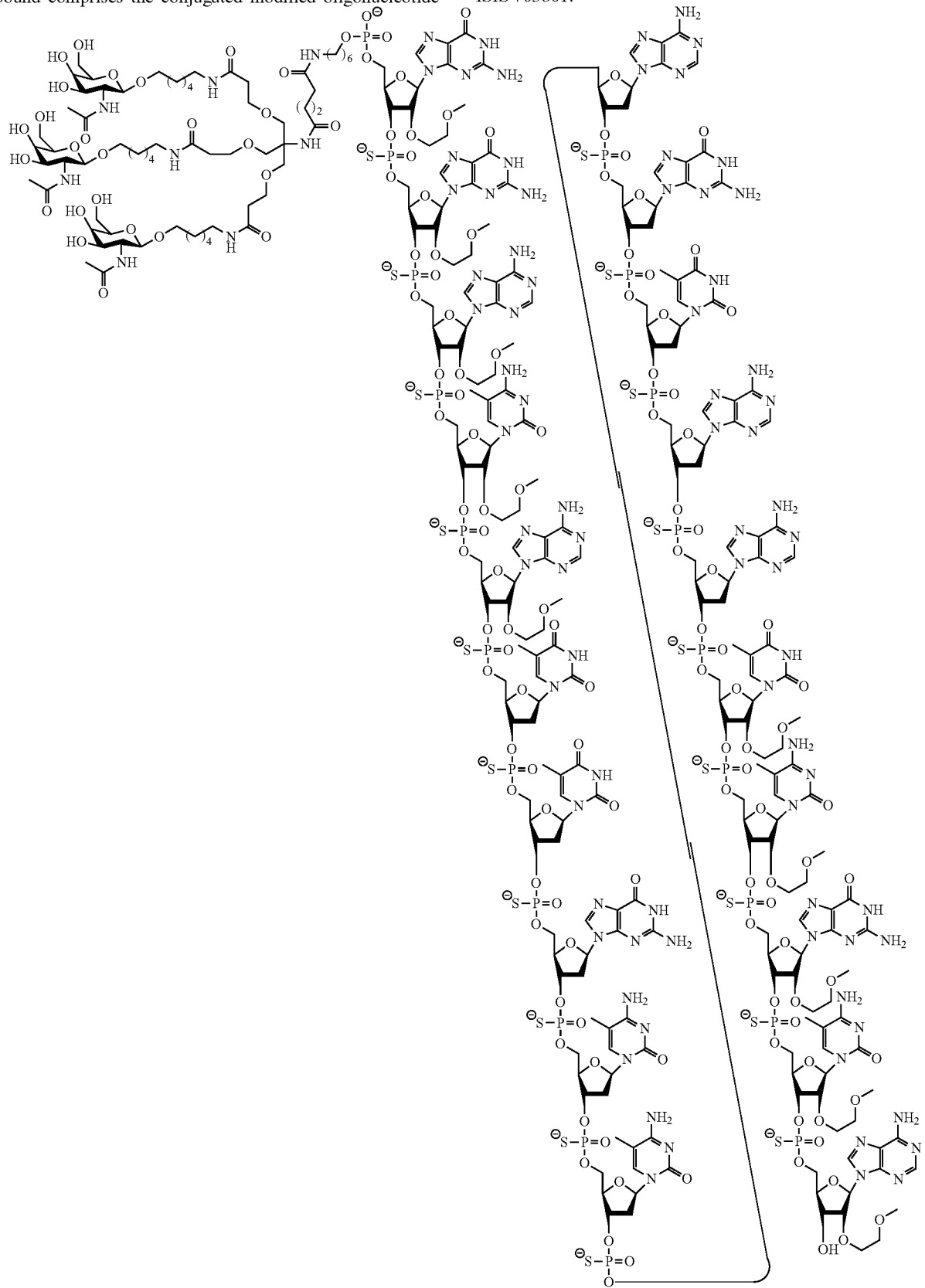

In certain embodiments, the present disclosure provides conjugated antisense compounds represented by the following structure. In certain embodiments, the antisense compound comprises the conjugated modified oligonucleotide ISIS 703802. In certain embodiments, the antisense compound consists of the conjugated modified oligonucleotide ISIS 703802.
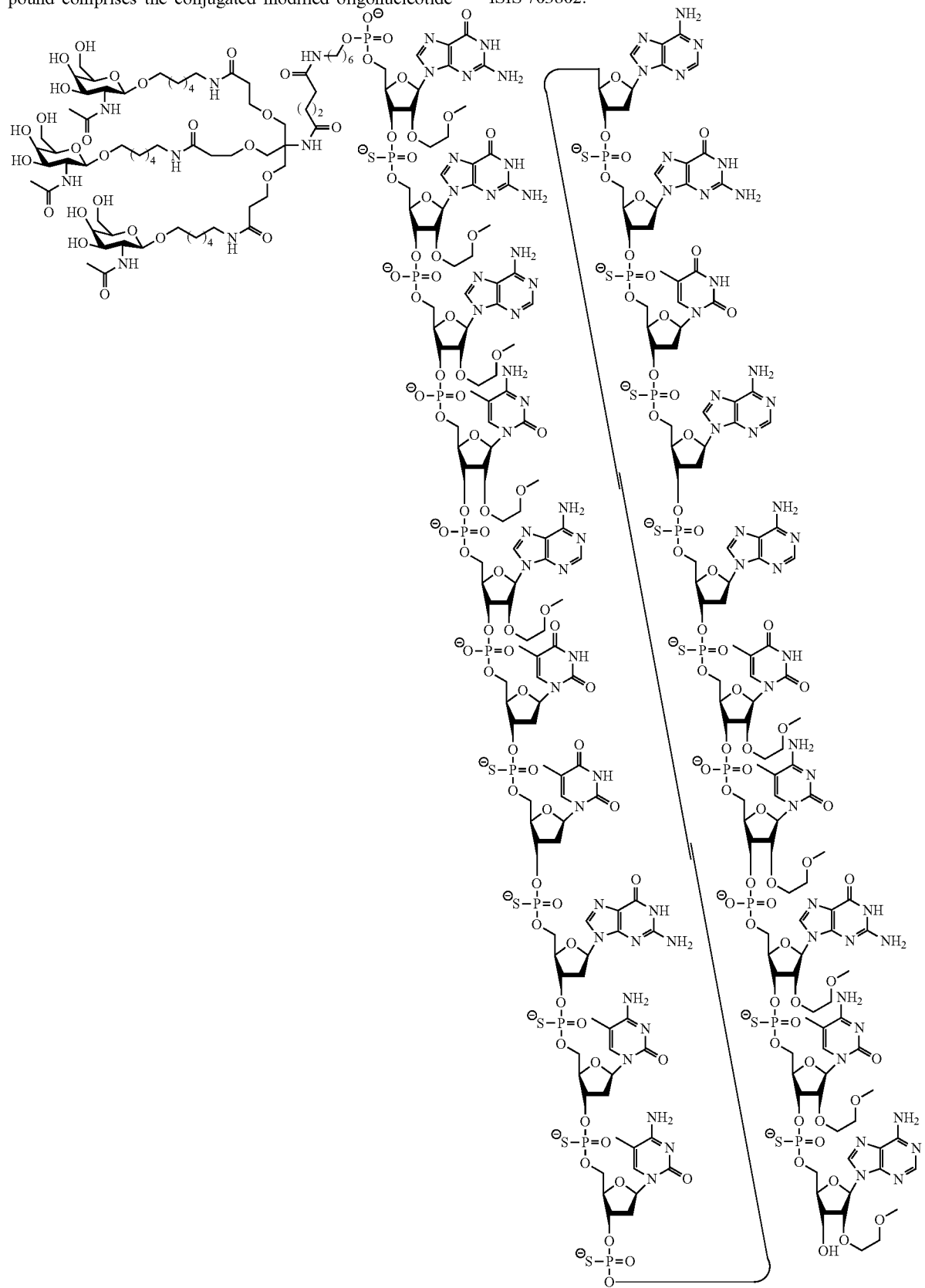

In certain embodiments, the present disclosure provides conjugated antisense compounds represented by the following structure. In certain embodiments, the antisense compound comprises a modified oligonucleotide with the nucleobase sequence of SEQ ID NO: 77 with a 5'-GalNAc with variability in the sugar mods of the wings. In certain embodiments, the antisense compound consists of a modified oligonucleotide with the nucleobase sequence of SEQ ID NO: 77 with a 5'-GalNAc with variability in the sugar mods of the wings.

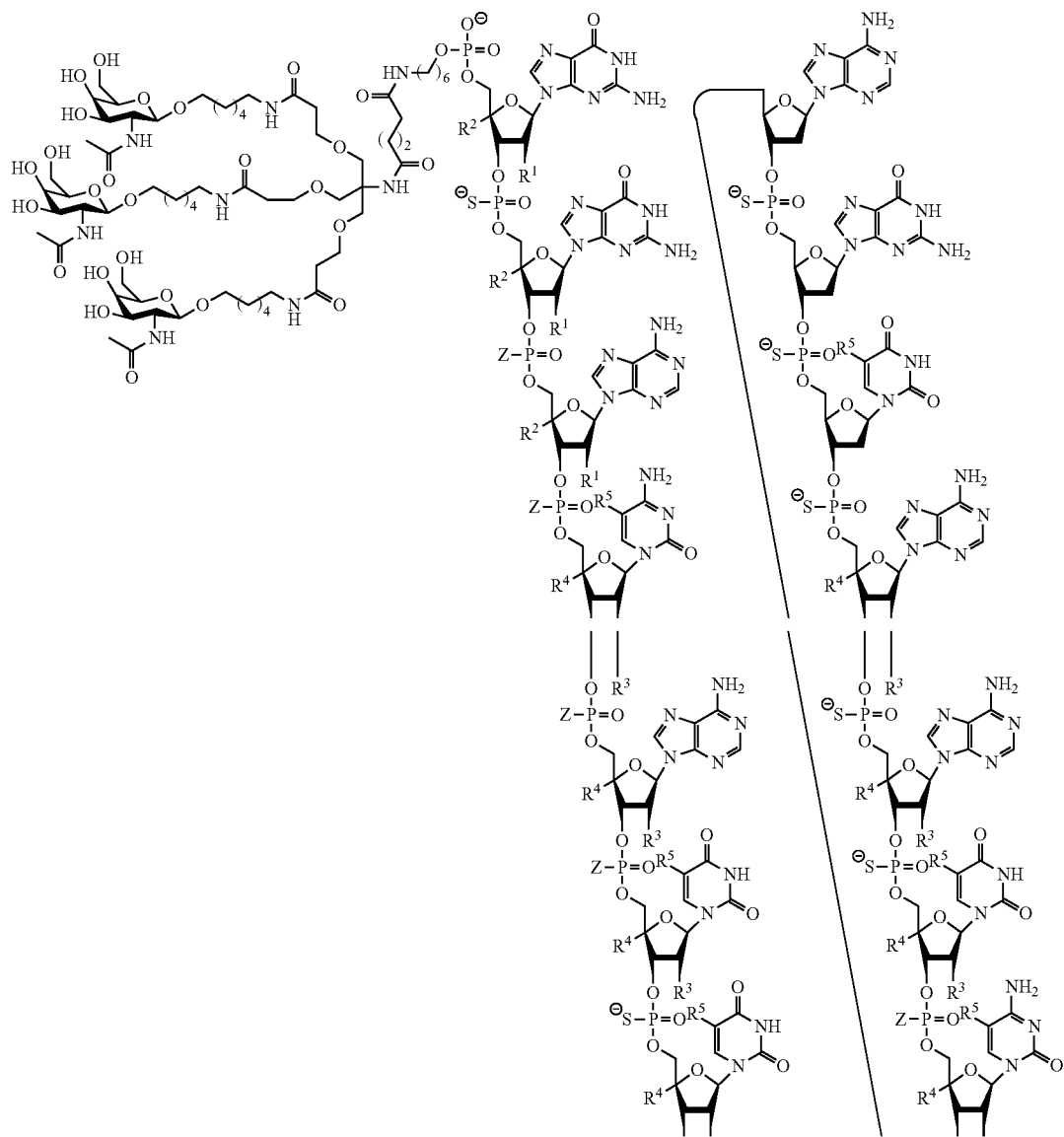

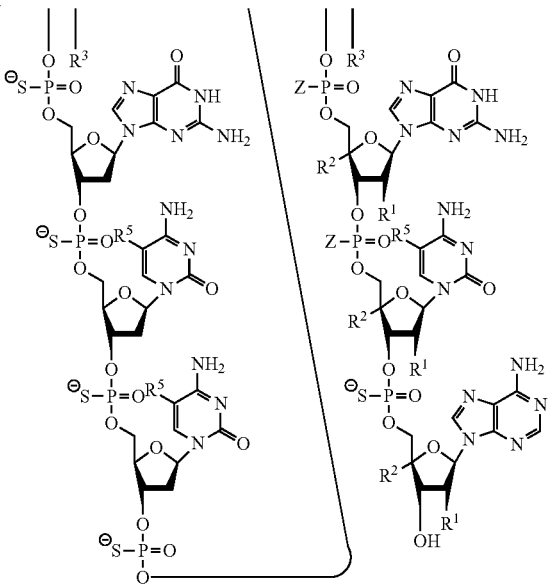

wherein either R¹ is —OCH₂CH₂OCH₃ (MOE) and R² is H; or R¹ and R² together form a bridge, wherein R¹ is —O— and R² is —CH₂—, —CH(CH₃)—, or —CH₂CH₂—, and R¹ and R² are directly connected such that the resulting bridge is selected from: —O—CH₂—, —O—CH(CH₃)—, and —O—CH₂CH₂—;

and for each pair of R³ and R⁴ on the same ring, independently for each ring: either R³ is selected from H and —OCH₂CH₂OCH₃ and R⁴ is H; or R³ and R⁴ together form a bridge, wherein R³ is —O—, and R⁴ is —CH₂—, —CH(CH₃)—, or —CH₂CH₂— and R³ and R⁴ are directly connected such that the resulting bridge is selected from: —O—CH₂—, —O—CH(CH₃)—, and —O—CH₂CH₂—;

and R⁵ is selected from H and —CH₃;

and Z is selected from S⁻ and O⁻.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of the nucleobase sequence of SEQ ID NO: 20. In certain embodiments, the compound comprises ISIS 544199 and a conjugate group. In certain embodiments, the compound consists of ISIS 544199 and a conjugate group.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of the nucleobase sequence of SEQ ID NO: 35. In certain embodiments, the compound comprises ISIS 560400 and a conjugate group. In certain embodiments, the compound consists of ISIS 560400 and a conjugate group.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of the nucleobase sequence of SEQ ID NO: 90. In certain embodiments, the compound comprises ISIS 567233 and a conjugate group. In certain embodiments, the compound consists of ISIS 567233 and a conjugate group.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of the nucleobase sequence of SEQ ID NO: 93. In certain embodiments, the compound comprises ISIS 567320 and a conjugate group. In certain embodiments, the compound consists of ISIS 567320 and a conjugate group.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of the nucleobase sequence of SEQ ID NO: 94. In certain embodiments, the compound comprises ISIS 567321 and a conjugate group. In certain embodiments, the compound consists of ISIS 567321 and a conjugate group.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, or 16 contiguous nucleobases of the nucleobase sequence of SEQ ID NO: 110. In certain embodiments, the compound comprises ISIS 559277 and a conjugate group. In certain embodiments, the compound consists of ISIS 559277 and a conjugate group.

Certain embodiments disclosed herein provide compounds or compositions comprising a modified oligonucleotide and a conjugate group, wherein the modified oligonucleotide consists of 12 to 30 linked nucleosides and having a nucleobase sequence comprising at least 8, at least 9, at least 10, at least 11, at least 12, at least 13, at least 14, at least 15, or 16 contiguous nucleobases of the nucleobase sequence of SEQ ID NO: 114. In certain embodiments, the compound comprises ISIS 561011 and a conjugate group. In certain embodiments, the compound consists of ISIS 561011 and a conjugate group.

In certain embodiments, the nucleobase sequence of the modified oligonucleotide is at least 70%, 75%, 80%, 85%, 90%, 95% or 100% complementary to any one of SEQ ID NO: 1-2 as measured over the entirety of the modified oligonucleotide.

In certain embodiments, the compound disclosed herein is a single-stranded oligonucleotide. In certain embodiments, the compound disclosed herein is a single-stranded modified oligonucleotide.

In certain embodiments, at least one internucleoside linkage of said modified oligonucleotide is a modified internucleoside linkage. In certain embodiments, the modified internucleoside linkage is a phosphorothioate internucleoside linkage. In certain embodiments, at least 1, at least 2, at least 3, at least 4, at least 5, at least 6, at least 7, at least 8, at least 9 or at least 10 internucleoside linkages of said modified oligonucleotide are phosphorothioate internucleoside linkages. In certain embodiments, each internucleoside linkage is a phosphorothioate internucleoside linkage. In certain embodiments, the modified oligonucleotide comprises at least 1, at least 2, at least 3, at least 4, at least 5, at least 6, at least 7, at least 8, at least 9 or at least 10 phosphodiester internucleoside linkages. In certain embodiments, each internucleoside linkage of the modified oligonucleotide is selected from a phosphodiester internucleoside linkage and a phosphorothioate internucleoside linkage.

In certain embodiments, at least one nucleoside of the modified oligonucleotide comprises a modified sugar. In certain embodiments, at least one modified sugar is a bicyclic sugar. In certain embodiments, at least one modified sugar comprises a 2'-O-methoxyethyl, a constrained ethyl, a 3'-fluoro-HNA or a 4'-(CH$_2$)$_n$—O-2' bridge, wherein n is 1 or 2.

In certain embodiments, at least one nucleoside of said modified oligonucleotide comprises a modified nucleobase. In certain embodiments, the modified nucleobase is a 5-methylcytosine.

Certain embodiments disclosed herein provide compounds or compositions comprising a modified oligonucleotide and a conjugate group, wherein the modified oligonucleotide has: a) a gap segment consisting of linked deoxynucleosides; b) a 5' wing segment consisting of linked nucleosides; and c) a 3' wing segment consisting of linked nucleosides. The gap segment is positioned between the 5' wing segment and the 3' wing segment and each nucleoside of each wing segment comprises a modified sugar.

In certain embodiments, the modified oligonucleotide consists of 12 to 30 linked nucleosides and comprises: a gap segment consisting of linked deoxynucleosides; a 5' wing segment consisting of linked nucleosides; a 3' wing segment consisting of linked nucleosides; wherein the gap segment is positioned between the 5' wing segment and the 3' wing segment and wherein each nucleoside of each wing segment comprises a modified sugar.

In certain embodiments, the compounds or compositions disclosed herein comprise a modified oligonucleotide consisting of 20 linked nucleosides having a nucleobase sequence comprising at least 8 contiguous nucleobases complementary to an equal length portion of SEQ ID NO: 1-2, wherein the modified oligonucleotide comprises: a gap segment consisting of ten linked deoxynucleosides; a 5' wing segment consisting of five linked nucleosides; and a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the modified oligonucleotide consists of 20 linked nucleosides and comprises: a gap segment consisting of ten linked deoxynucleosides; a 5' wing segment consisting of five linked nucleosides; a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the compounds or compositions disclosed herein comprise a modified oligonucleotide consisting of 20 linked nucleosides having a nucleobase sequence comprising at least 8 contiguous nucleobases of a nucleobase sequence selected of SEQ ID NO: 77, wherein the modified oligonucleotide comprises: a gap segment consisting of ten linked deoxynucleosides; a 5' wing segment consisting of five linked nucleosides; and a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the modified oligonucleotide consists of 20 linked nucleosides with the nucleobase sequence of SEQ ID NO: 77 and comprises: a gap segment consisting of ten linked deoxynucleosides; a 5' wing segment consisting of five linked nucleosides; a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the compounds or compositions disclosed herein comprise a modified oligonucleotide consisting of 20 linked nucleosides having a nucleobase sequence comprising at least 8 contiguous nucleobases of a nucleobase sequence selected of SEQ ID NO: 20, wherein the modified oligonucleotide comprises: a gap segment consisting of ten linked deoxynucleosides; a 5' wing segment consisting of five linked nucleosides; and a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the modified oligonucleotide consists of 20 linked nucleosides with the nucleobase sequence of SEQ ID NO: 20 and comprises: a gap segment consisting of ten linked deoxynucleosides; a 5' wing segment consisting of five linked nucleosides; a 3' wing segment consisting of five linked nucleosides; wherein the gap segment is positioned between the 5' wing segment and the 3' wing segment; wherein each nucleoside of each wing segment comprises a 2'-O-methoxyethyl sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the compounds or compositions disclosed herein comprise a modified oligonucleotide consisting of 16 linked nucleosides having a nucleobase sequence comprising at least 8 contiguous nucleobases of a nucleobase sequence of SEQ ID NO: 110, wherein the modified oligonucleotide comprises: a gap segment consisting of ten linked deoxynucleosides; a 5' wing segment consisting of three linked nucleosides; and a 3' wing segment consisting of three linked nucleosides; wherein the gap segment is positioned between the 5' wing segment and the 3' wing segment; wherein each wing segment comprises at least one 2'-O-methoxyethyl sugar and at least one cEt sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the modified oligonucleotide consists of 16 linked nucleosides with the nucleobase sequence of SEQ ID NO: 110 and comprises: a gap segment consisting of ten linked deoxynucleosides; a 5' wing segment consisting of three linked nucleosides; a 3' wing segment consisting of three linked nucleosides; wherein the gap segment is positioned between the 5' wing segment and the 3' wing segment; wherein each wing segment comprises at least one 2'-O-methoxyethyl sugar and at least one cEt sugar; wherein at least one internucleoside linkage is a phosphorothioate linkage and wherein each cytosine residue is a 5-methylcytosine. In certain embodiments, each internucleoside linkage is a phosphorothioate linkage.

In certain embodiments, the conjugate group is linked to the modified oligonucleotide at the 5' end of the modified oligonucleotide. In certain embodiments, the conjugate group is linked to the modified oligonucleotide at the 3' end of the modified oligonucleotide.

In certain embodiments, the conjugate group comprises exactly one ligand. In certain embodiments, the conjugate group comprises one or more ligands. In certain embodiments, the conjugate group comprises exactly two ligands. In certain embodiments, the conjugate group comprises two or more ligands. In certain embodiments, the conjugate group comprises three or more ligands. In certain embodiments, the conjugate group comprises exactly three ligands. In certain embodiments, each ligand is selected from among: a polysaccharide, modified polysaccharide, mannose, galactose, a mannose derivative, a galactose derivative, D-mannopyranose, L-Mannopyranose, D-Arabinose, L-Galactose, D-xylofuranose, L-xylofuranose, D-glucose, L-glucose, D-Galactose, L-Galactose, α-D-Mannofuranose, β-D-Mannofuranose, α-D-Mannopyranose, β-D-Mannopyranose, α-D-Glucopyranose, β-D-Glucopyranose, α-D-Glucofuranose, β-D-Glucofuranose, α-D-fructofuranose, α-D-fructopyranose, α-D-Galactopyranose, β-D-Galactopyranose, α-D-Galactofuranose, β-D-Galactofuranose, glucosamine, sialic acid, α-D-galactosamine, N-Acetylgalactosamine, 2-Amino-3-O—[(R)-1-carboxyethyl]-2-deoxy-β-D-glucopyranose, 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose, N-Glycoloyl-α-neuraminic acid, 5-thio-β-D-glucopyranose, methyl 2,3,4-tri-O-acetyl-1-thio-6-O-trityl-α-D-glucopyranoside, 4-Thio-β-D-galactopyranose, ethyl 3,4,6,7-tetra-O-acetyl-2-deoxy-1,5-dithio-α-D-gluco-heptopyranoside, 2,5-Anhydro-D-allononitrile, ribose, D-ribose, D-4-thioribose, L-ribose, L-4-thioribose. In certain embodiments, each ligand is N-acetyl galactosamine.

In certain embodiments, the conjugate group comprises:

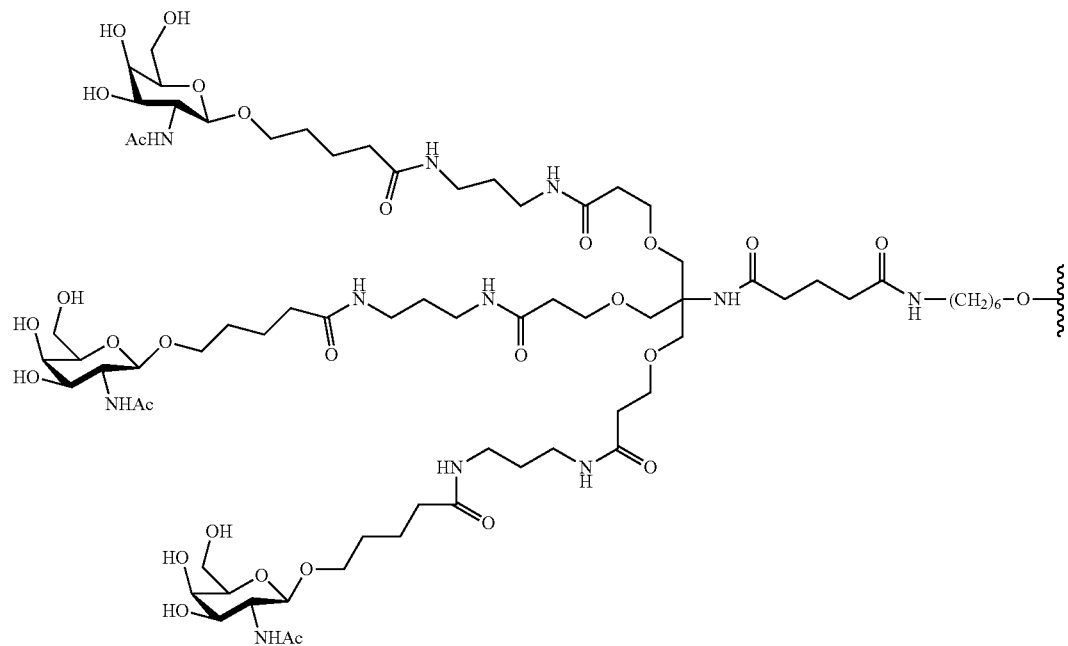

In certain embodiments, the conjugate group comprises:
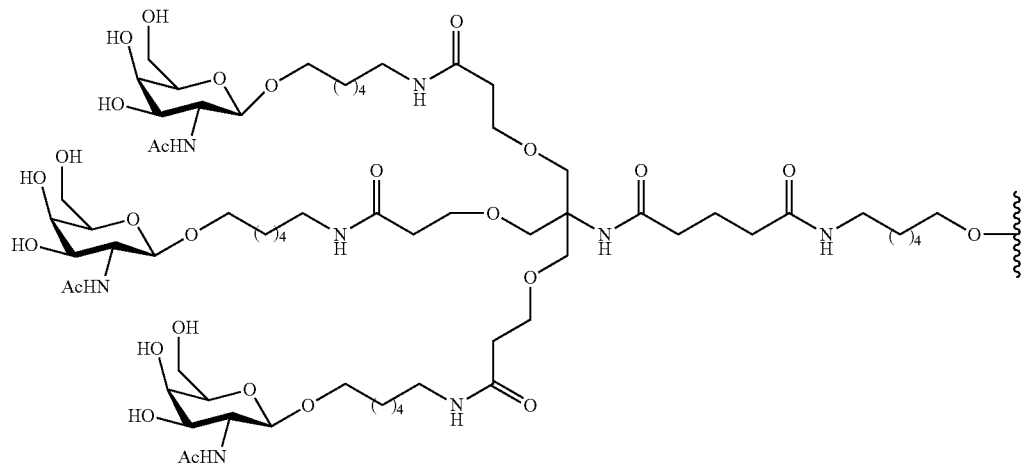
In certain embodiments, the conjugate group comprises:
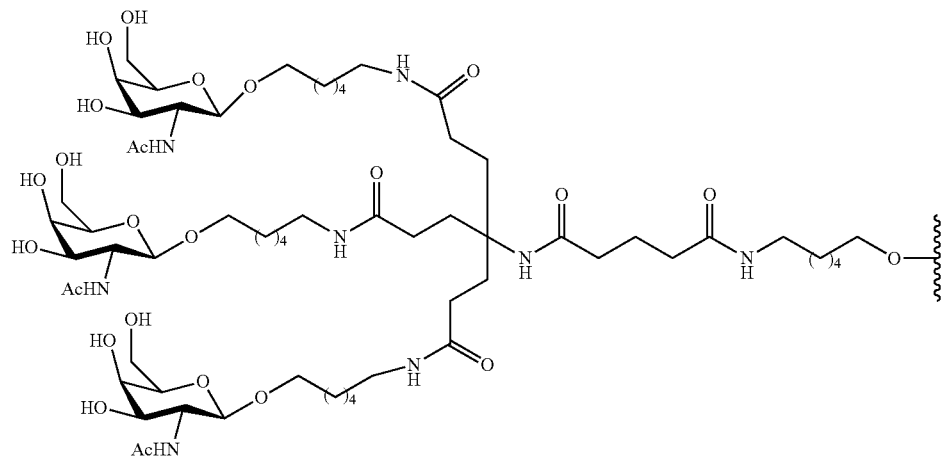
In certain embodiments, the conjugate group comprises:
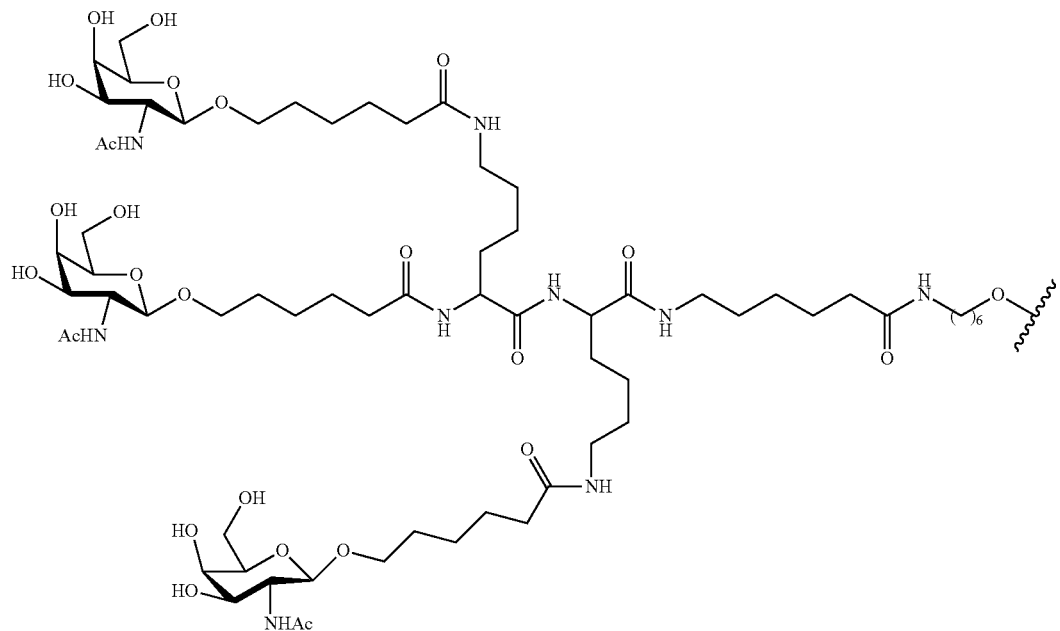

In certain embodiments, the conjugate group comprises:

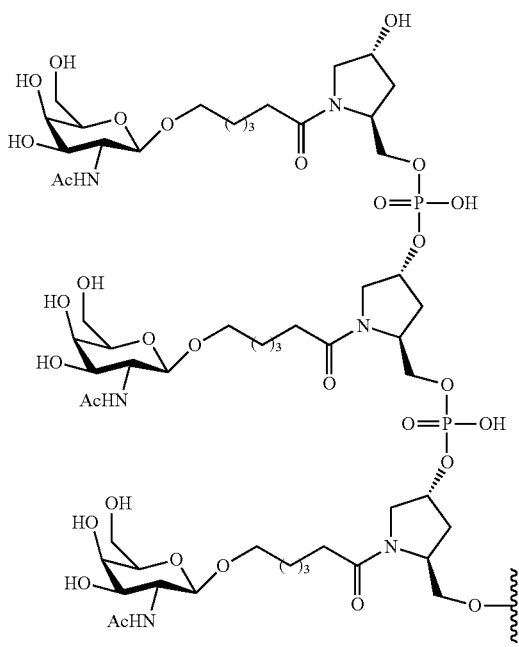

In certain embodiments, the conjugate group comprises at least one phosphorus linking group or neutral linking group.

In certain embodiments, the conjugate group comprises a structure selected from among:

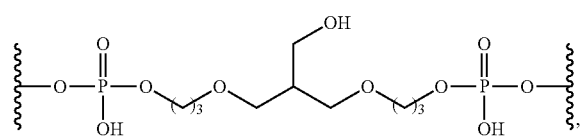

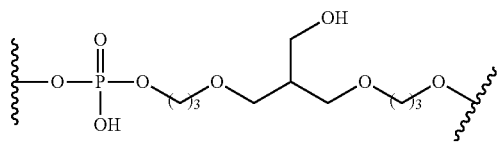

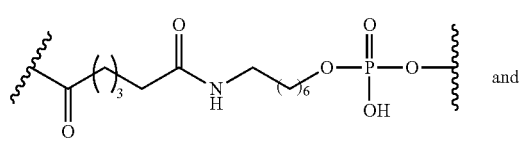

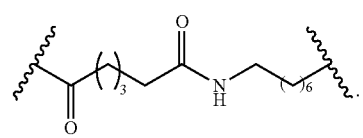

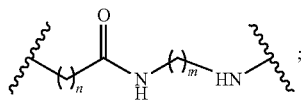

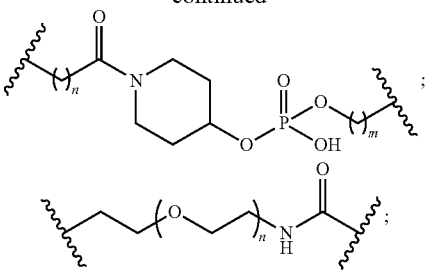

wherein n is from 1 to 12; and
wherein m is from 1 to 12.

In certain embodiments, the conjugate group has a tether having a structure selected from among:

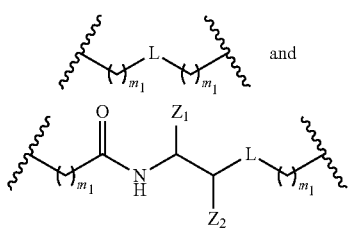

wherein L is either a phosphorus linking group or a neutral linking group;
$Z_1$ is $C(=O)O-R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

In certain embodiments, the conjugate group has a tether having a structure selected from among:

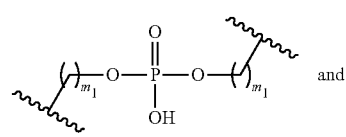

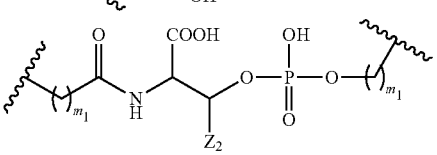

wherein $Z_2$ is H or $CH_3$; and
each $m_1$ is, independently, from 0 to 20 wherein at least one $m_1$ is greater than 0 for each tether.

In certain embodiments, the conjugate group has tether having a structure selected from among:

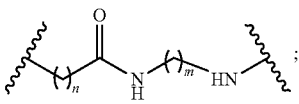

-continued

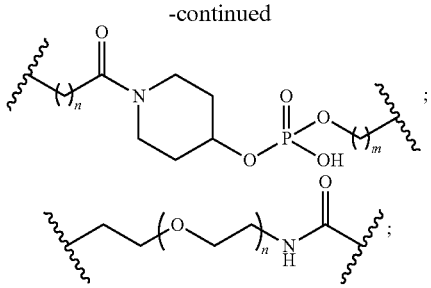

wherein n is from 1 to 12; and
wherein m is from 1 to 12.

In certain embodiments, the conjugate group is covalently attached to the modified oligonucleotide.

In certain embodiments, the compound has a structure represented by the formula:

wherein
A is the modified oligonucleotide;
B is the cleavable moiety
C is the conjugate linker
D is the branching group
each E is a tether;
each F is a ligand; and
q is an integer between 1 and 5.

In certain embodiments, the compound has a structure represented by the formula:

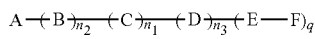

wherein:
A is the modified oligonucleotide;
B is the cleavable moiety
C is the conjugate linker
D is the branching group
each E is a tether;
each F is a ligand;
each n is independently 0 or 1; and
q is an integer between 1 and 5.

In certain embodiments, the compound has a structure represented by the formula:

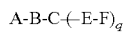

wherein
A is the modified oligonucleotide;
B is the cleavable moiety;
C is the conjugate linker;
each E is a tether;
each F is a ligand; and
q is an integer between 1 and 5.

In certain embodiments, the compound has a structure represented by the formula:

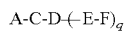

wherein
A is the modified oligonucleotide;
C is the conjugate linker;
D is the branching group;
each E is a tether;
each F is a ligand; and
q is an integer between 1 and 5.

In certain embodiments, the compound has a structure represented by the formula:

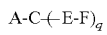

wherein
A is the modified oligonucleotide;
C is the conjugate linker;
each E is a tether;
each F is a ligand; and
q is an integer between 1 and 5.

In certain embodiments, the compound has a structure represented by the formula:

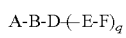

wherein
A is the modified oligonucleotide;
B is the cleavable moiety;
D is the branching group;
each E is a tether;
each F is a ligand; and
q is an integer between 1 and 5.

In certain embodiments, the compound has a structure represented by the formula:

wherein
A is the modified oligonucleotide;
B is the cleavable moiety;
each E is a tether;
each F is a ligand; and
q is an integer between 1 and 5.

In certain embodiments, the compound has a structure represented by the formula:

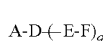

wherein
A is the modified oligonucleotide;
D is the branching group;
each E is a tether;
each F is a ligand; and
q is an integer between 1 and 5.

In certain embodiments, the conjugate linker has a structure selected from among:

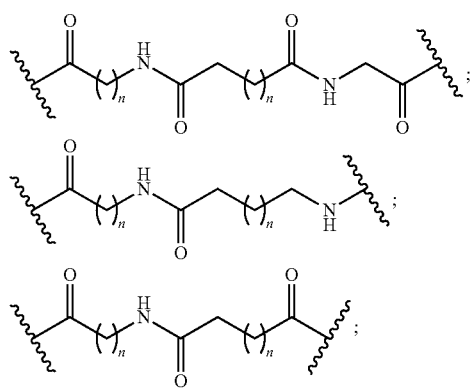

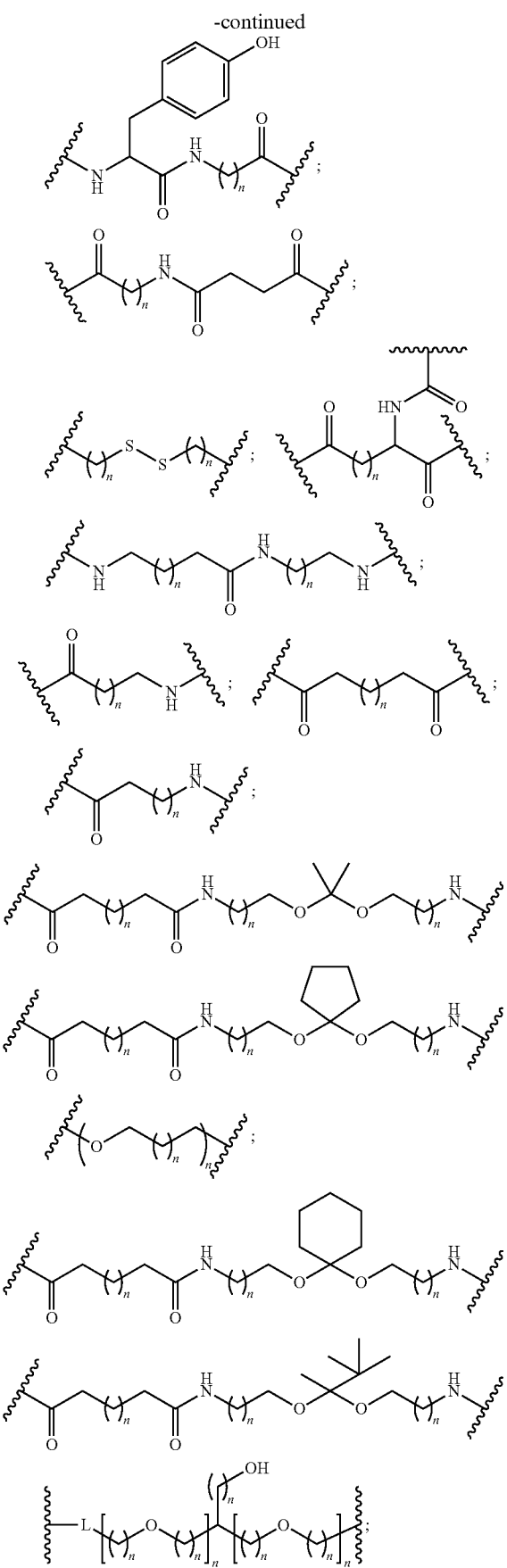
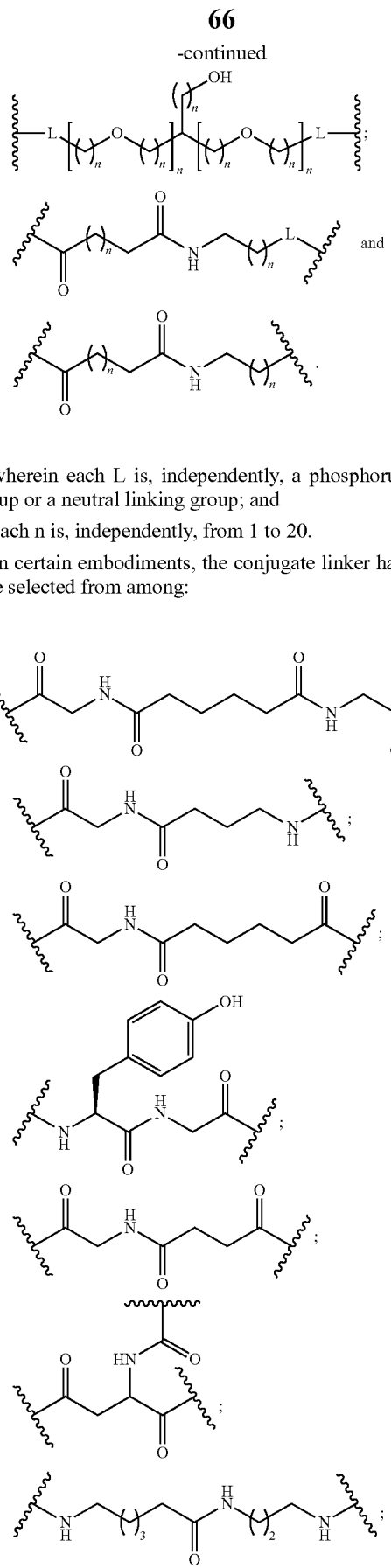
wherein each L is, independently, a phosphorus linking group or a neutral linking group; and
each n is, independently, from 1 to 20.
In certain embodiments, the conjugate linker has a structure selected from among:

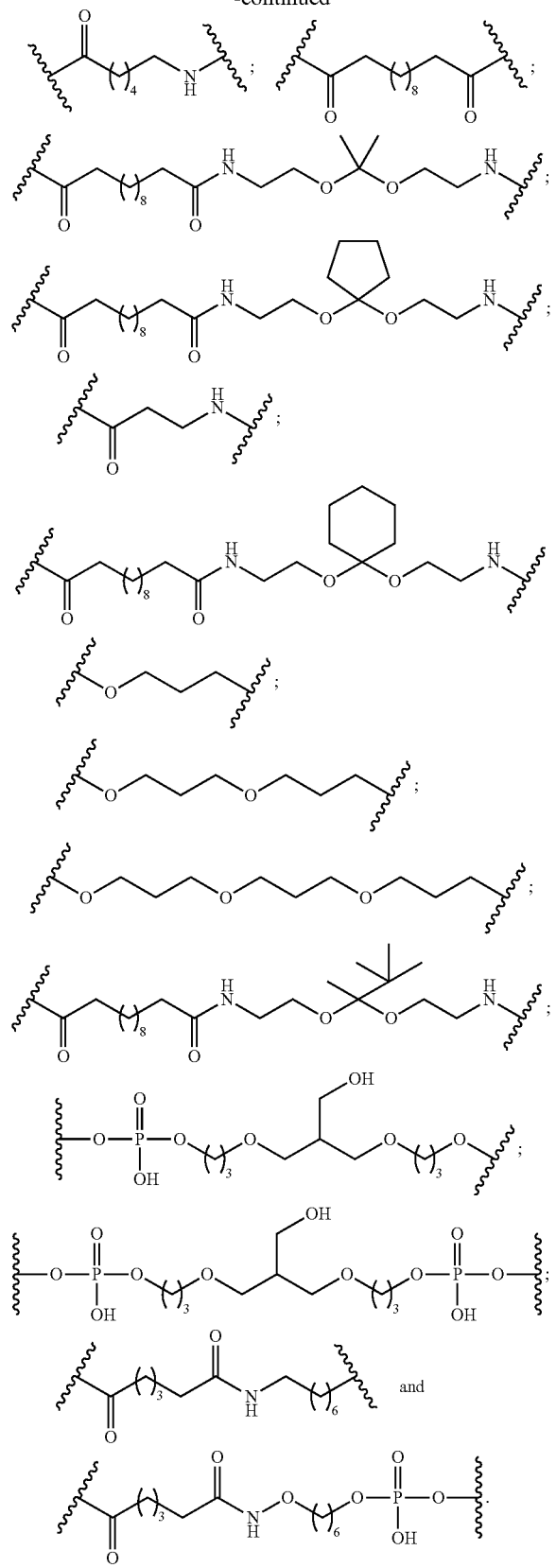
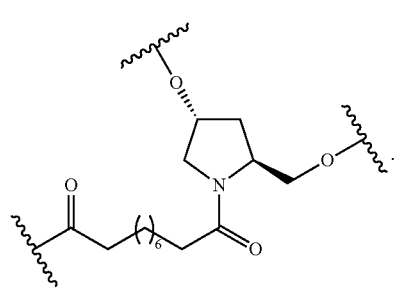
In certain embodiments, the conjugate linker has a structure selected from among:
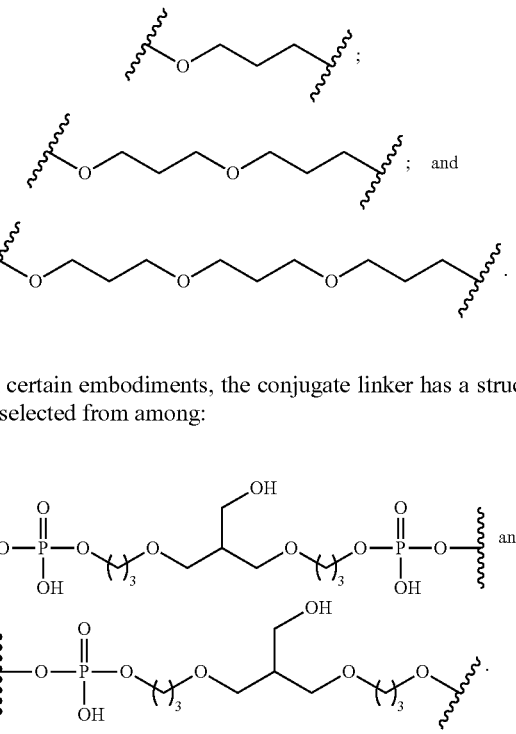
In certain embodiments, the conjugate linker has a structure selected from among:
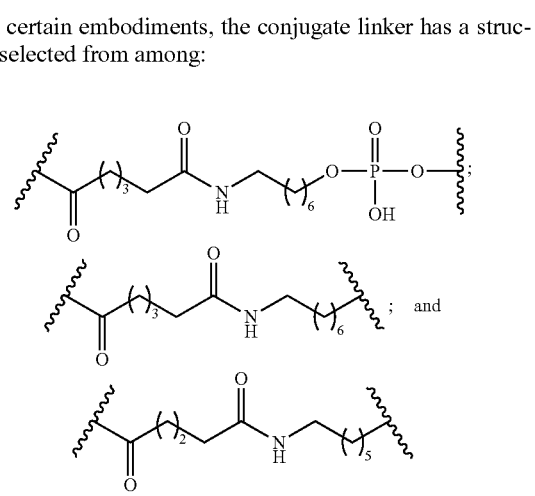
In certain embodiments, the conjugate linker has the following structure:

In certain embodiments, the conjugate linker comprises a pyrrolidine. In certain embodiments, the conjugate linker does not comprise a pyrrolidine.

In certain embodiments, the conjugate linker comprises PEG.

In certain embodiments, the conjugate linker comprises an amide. In certain embodiments, the conjugate linker comprises at least two amides. In certain embodiments, the conjugate linker does not comprise an amide. In certain embodiments, the conjugate linker comprises a polyamide.

In certain embodiments, the conjugate linker comprises an amine.

In certain embodiments, the conjugate linker comprises one or more disulfide bonds.

In certain embodiments, the conjugate linker comprises a protein binding moiety. In certain embodiments, the protein binding moiety comprises a lipid. In certain embodiments, the protein binding moiety is selected from among: cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid. In certain embodiments, the protein binding moiety is selected from among: a C16 to C22 long chain saturated or unsaturated fatty acid, cholesterol, cholic acid, vitamin E, adamantane or 1-pentafluoropropyl.

In certain embodiments, the conjugate linker has a structure selected from among:

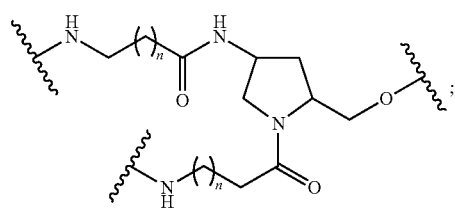

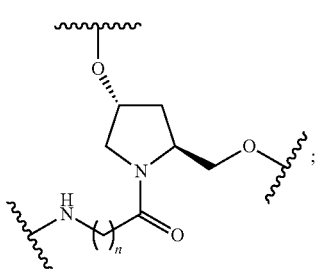

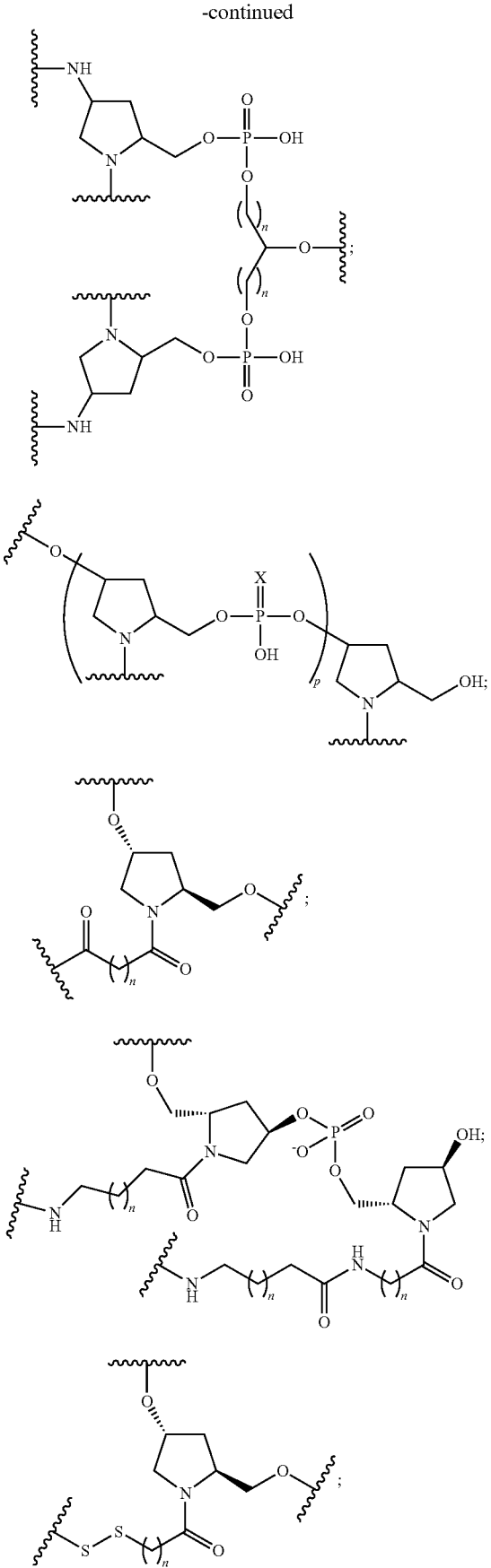

71
-continued
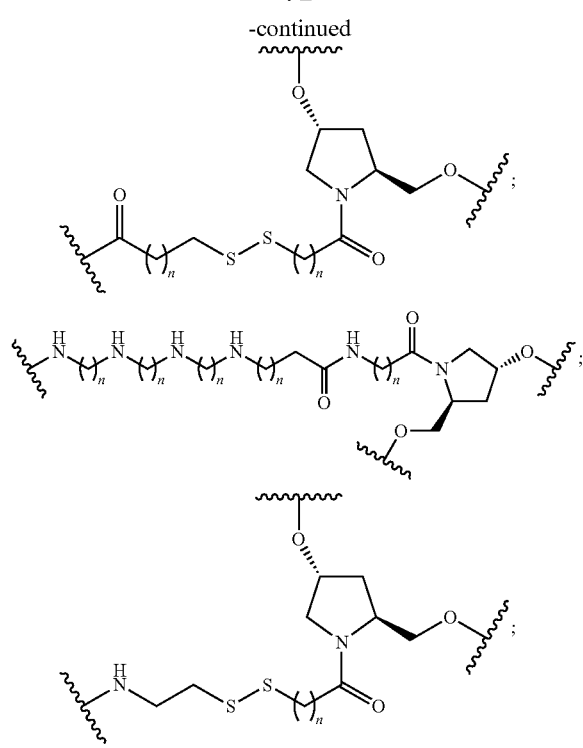
72
-continued
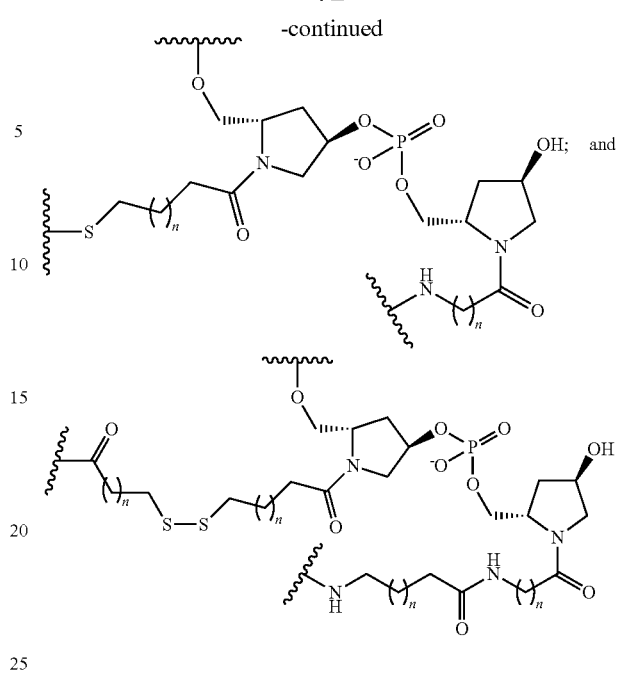
wherein each n is, independently, is from 1 to 20; and p is from 1 to 6.
In certain embodiments, the conjugate linker has a structure selected from among:
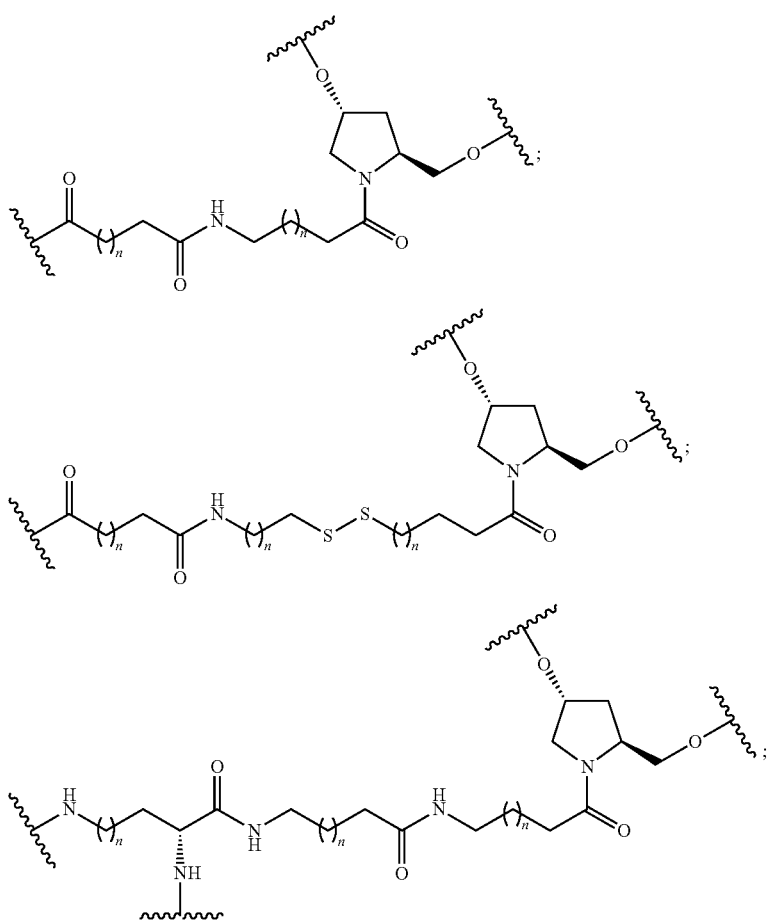

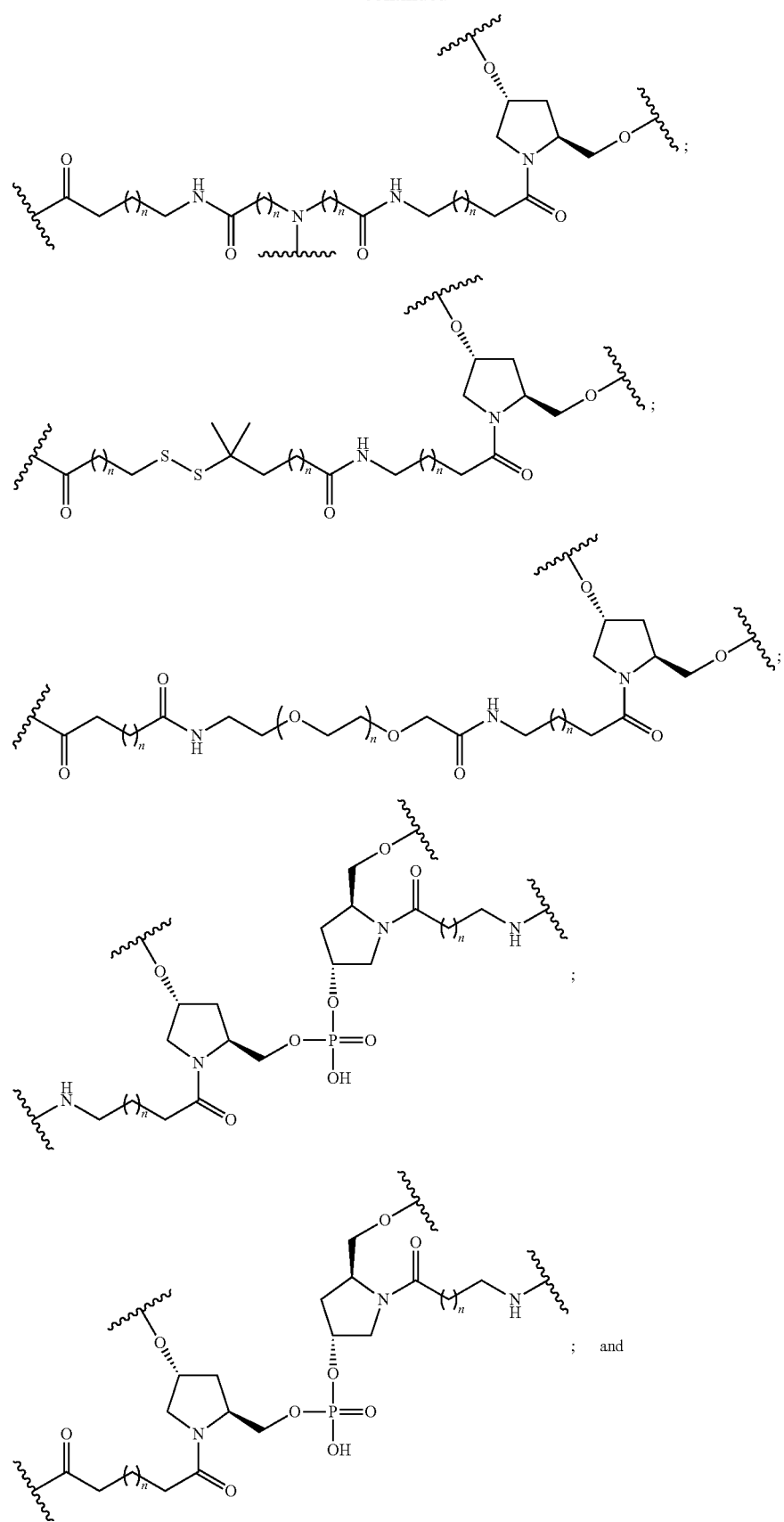

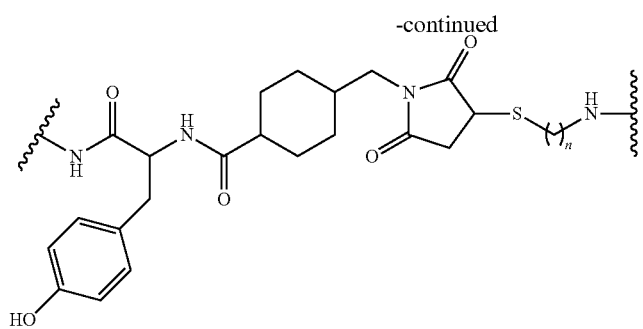
wherein each n is, independently, from 1 to 20.
In certain embodiments, the conjugate linker has a structure selected from among:
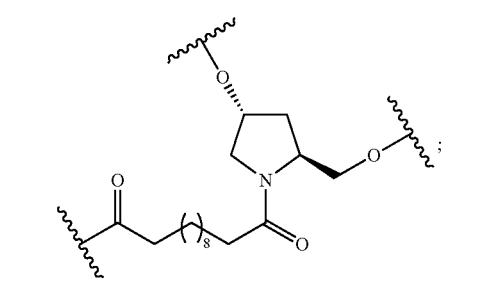
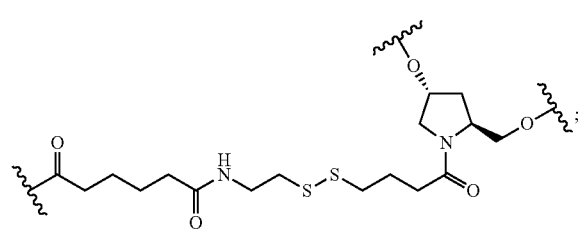
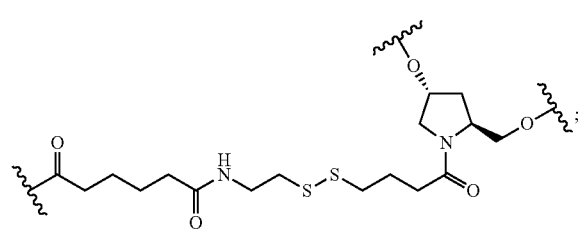
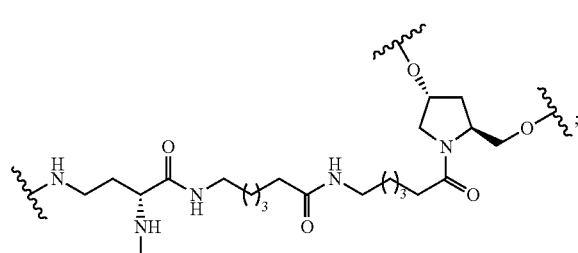
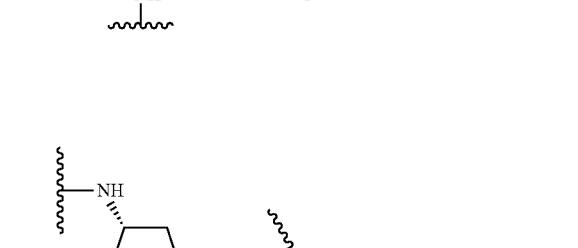
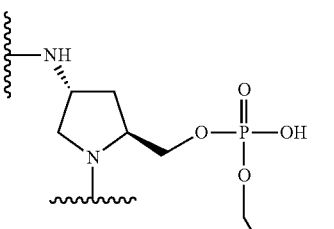
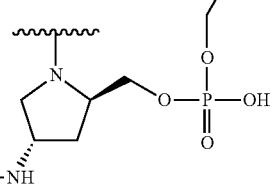
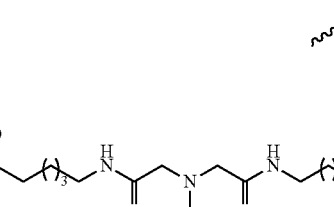
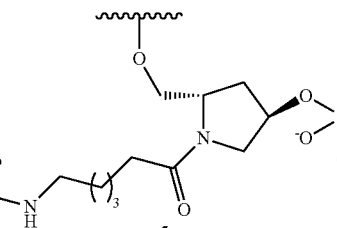
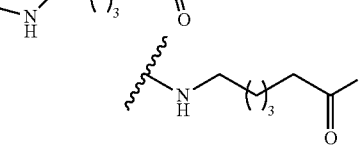

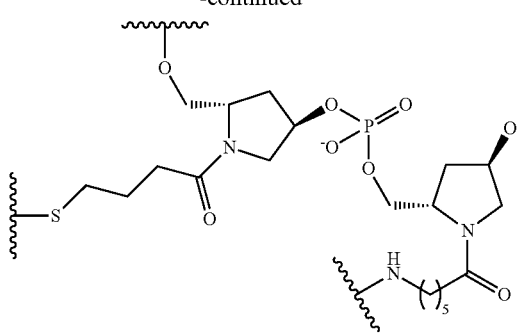
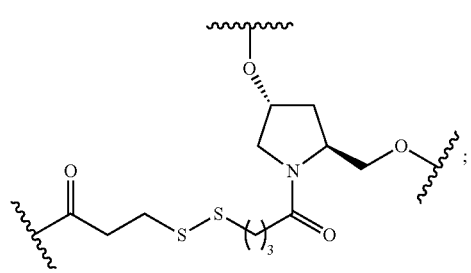
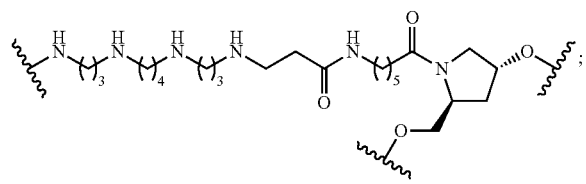
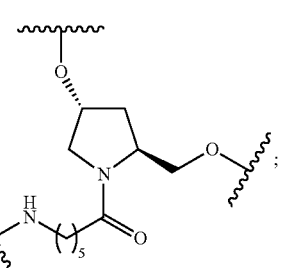
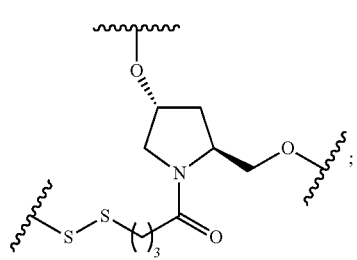
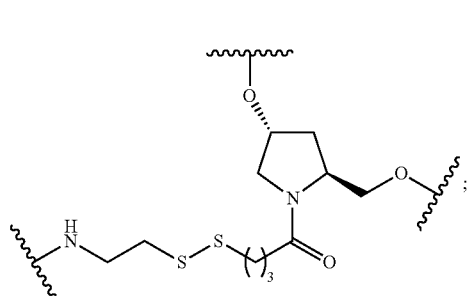
In certain embodiments, the conjugate linker has a structure selected from among:
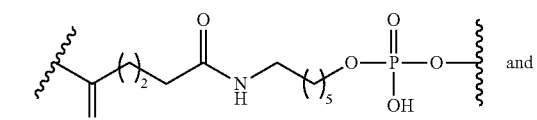
wherein n is from 1 to 20.
In certain embodiments, the conjugate linker has a structure selected from among:
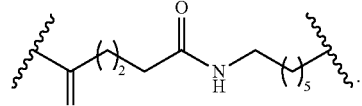
In certain embodiments, the conjugate linker has a structure selected from among:

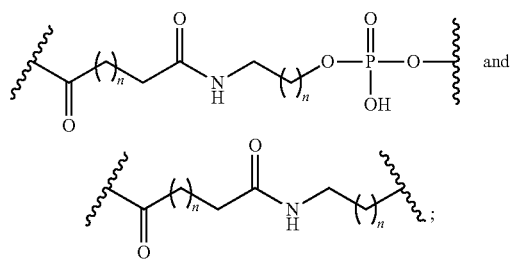

wherein each n is independently, 0, 1, 2, 3, 4, 5, 6, or 7.

In certain embodiments, the conjugate linker has the following structure:

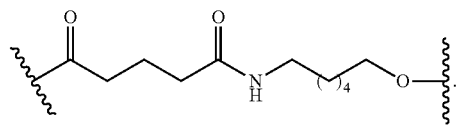

In certain embodiments, the branching group has one of the following structures:

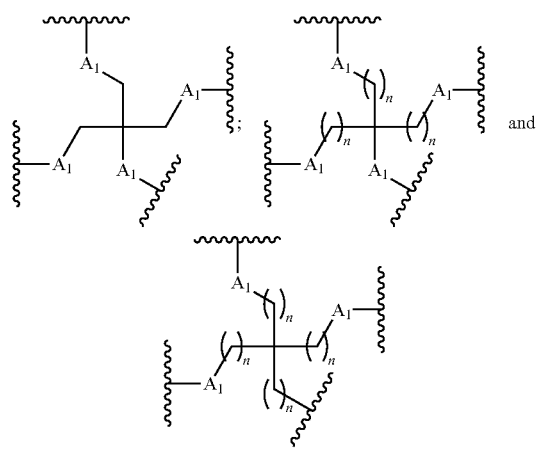

wherein each $A_1$ is independently, O, S, C=O or NH; and each n is, independently, from 1 to 20.

In certain embodiments, the branching group has one of the following structures:

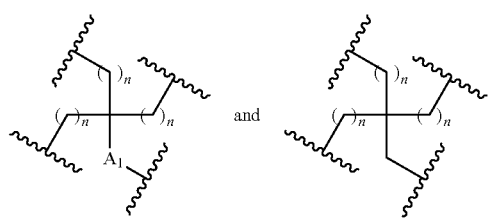

wherein each $A_1$ is independently, O, S, C=O or NH; and each n is, independently, from 1 to 20.

In certain embodiments, the branching group has the following structure:

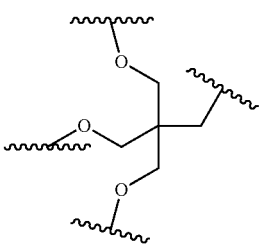

In certain embodiments, the branching group has the following structure:

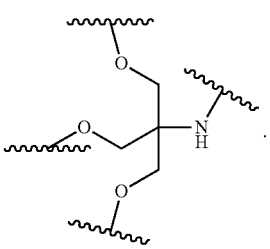 [SMILES: *NC(CO*)(CO*)CO*]

In certain embodiments, the branching group has the following structure:

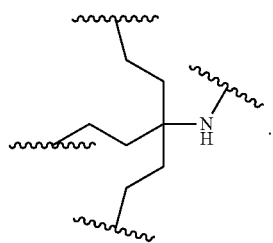 [SMILES: *CCC(CC*)(CC*)N*]

In certain embodiments, the branching group has the following structure:

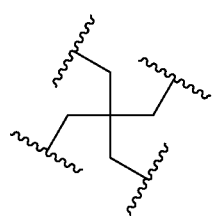

In certain embodiments, the branching group comprises an ether.

In certain embodiments, the branching group has the following structure:

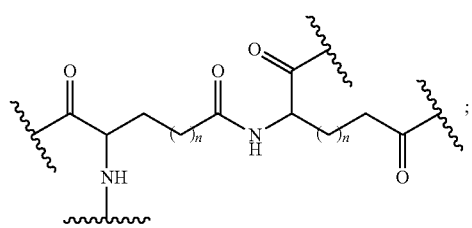

-continued
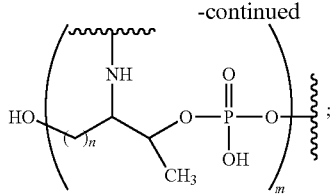
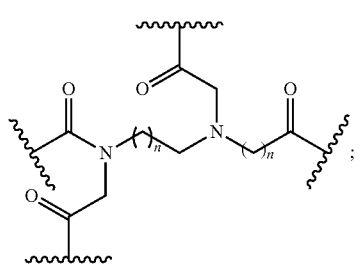
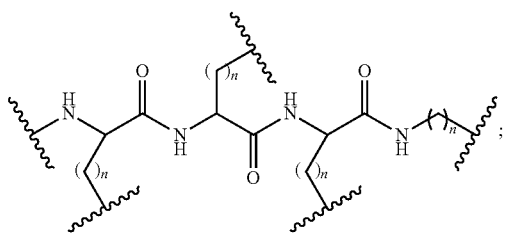
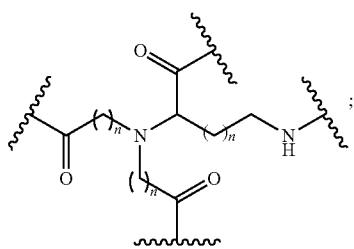
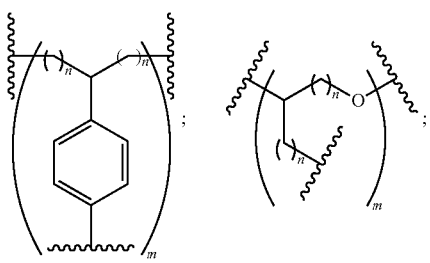
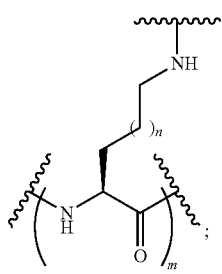
-continued
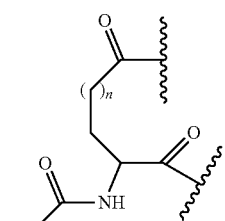
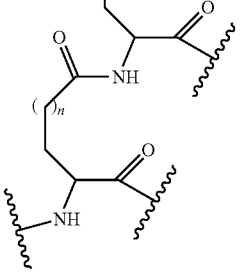
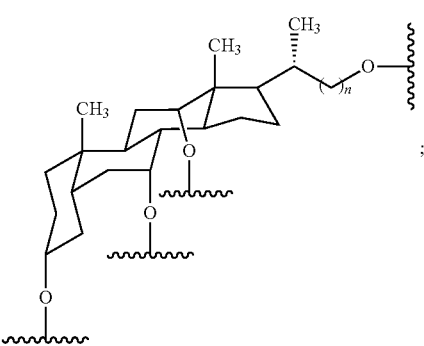
; and
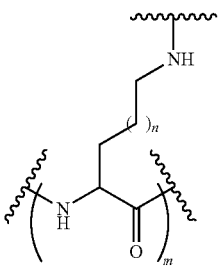
each n is, independently, from 1 to 20; and
m is from 2 to 6.
In certain embodiments, the branching group has the following structure:
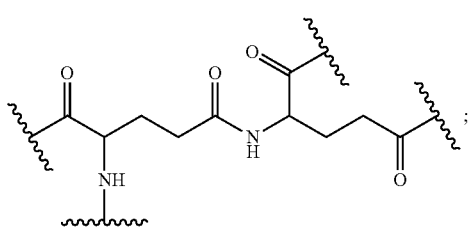

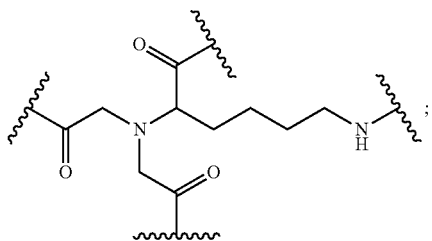
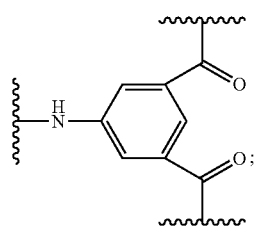
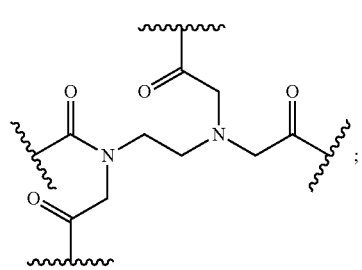
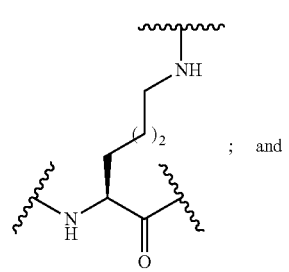
; and
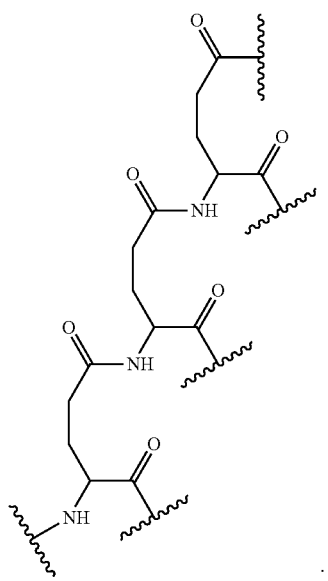 [SMILES: *NC(CCC(=O)NC(CCC(=O)NC(CCC(*)=O)C(*)=O)C(*)=O)C(*)=O]
In certain embodiments, the branching group has the following structure:
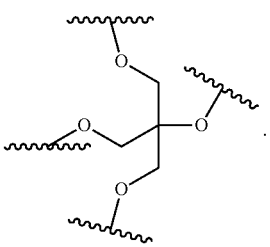 [SMILES: *OCC(CO*)(CO*)O*]
In certain embodiments, the branching group comprises:
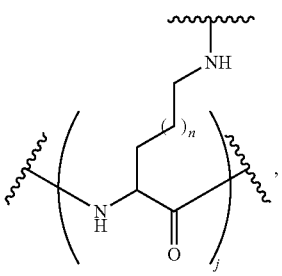
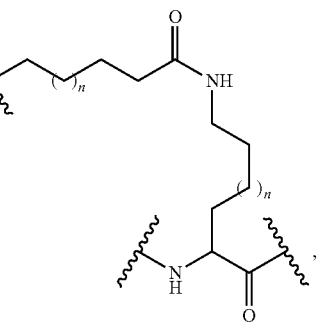
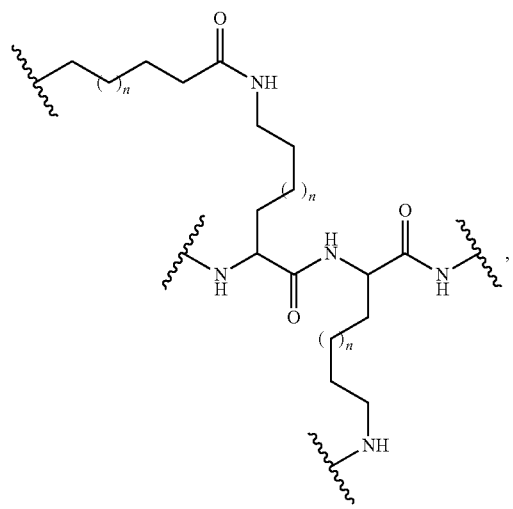

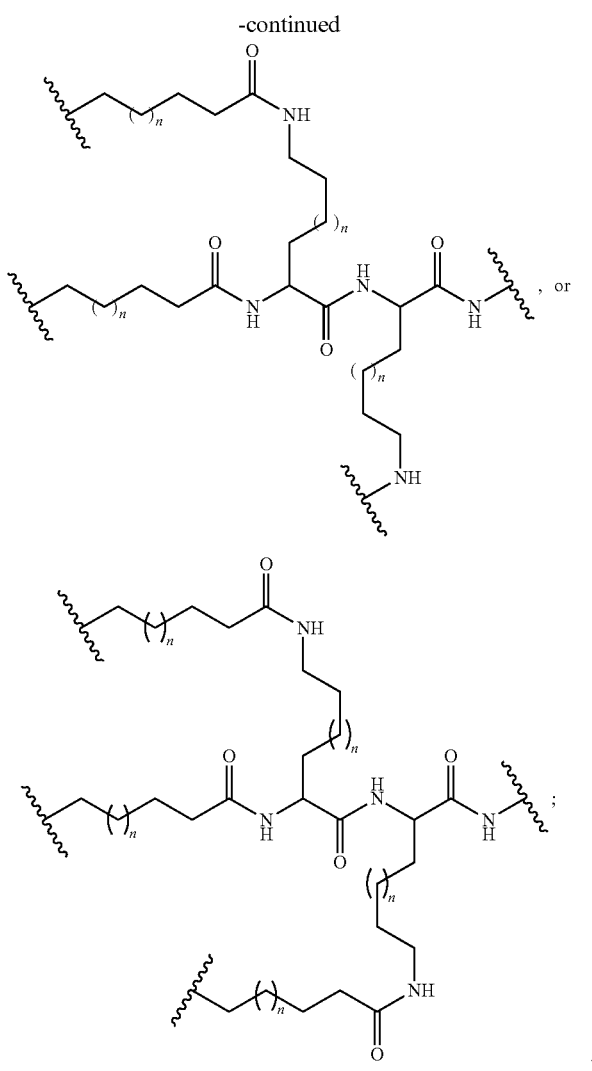
wherein each j is an integer from 1 to 3; and
wherein each n is an integer from 1 to 20.
In certain embodiments, the branching group comprises:
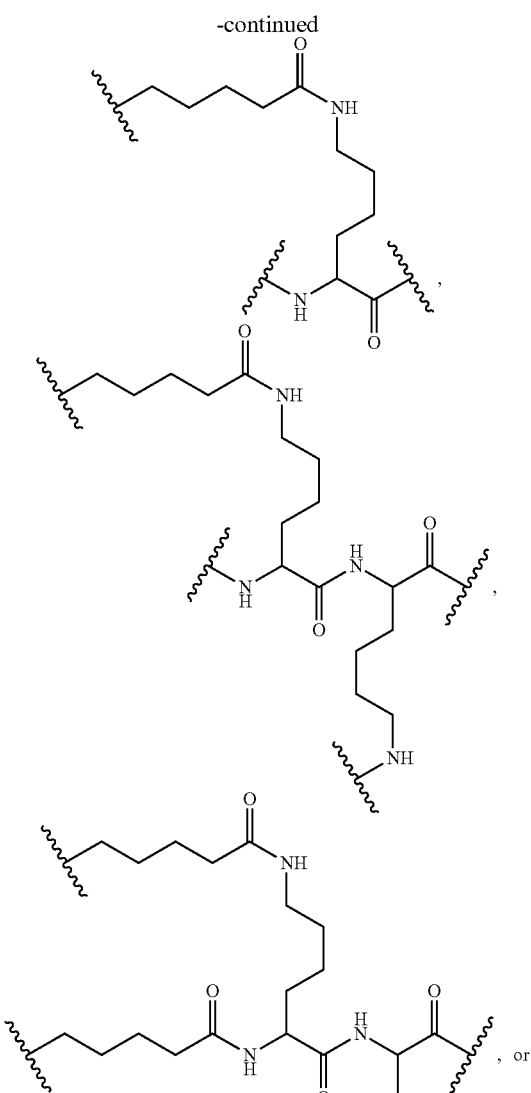

In certain embodiments, each tether is selected from among:

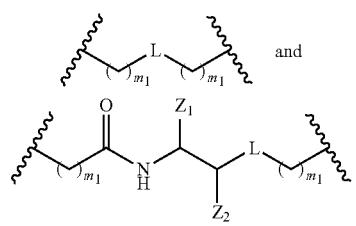

wherein L is selected from a phosphorus linking group and a neutral linking group;
$Z_1$ is $C(=O)O-R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

In certain embodiments, each tether is selected from among:

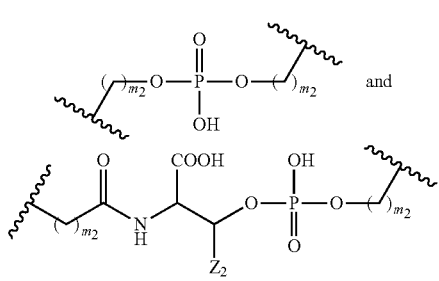

wherein $Z_2$ is H or $CH_3$; and
each $m_2$ is, independently, from 0 to 20 wherein at least one $m_2$ is greater than 0 for each tether.

In certain embodiments, each tether is selected from among:

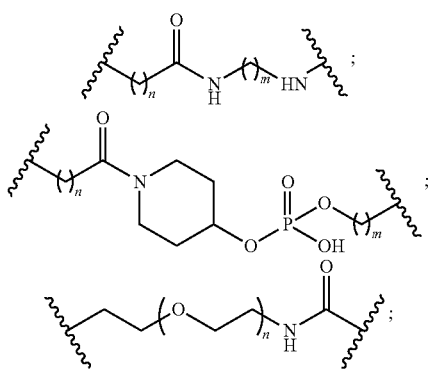

wherein n is from 1 to 12; and
wherein m is from 1 to 12.

In certain embodiments, at least one tether comprises ethylene glycol.

In certain embodiments, at least one tether comprises an amide. In certain embodiments, at least one tether comprises a polyamide.

In certain embodiments, at least one tether comprises an amine.

In certain embodiments, at least two tethers are different from one another. In certain embodiments, all of the tethers are the same as one another.

In certain embodiments, each tether is selected from among:

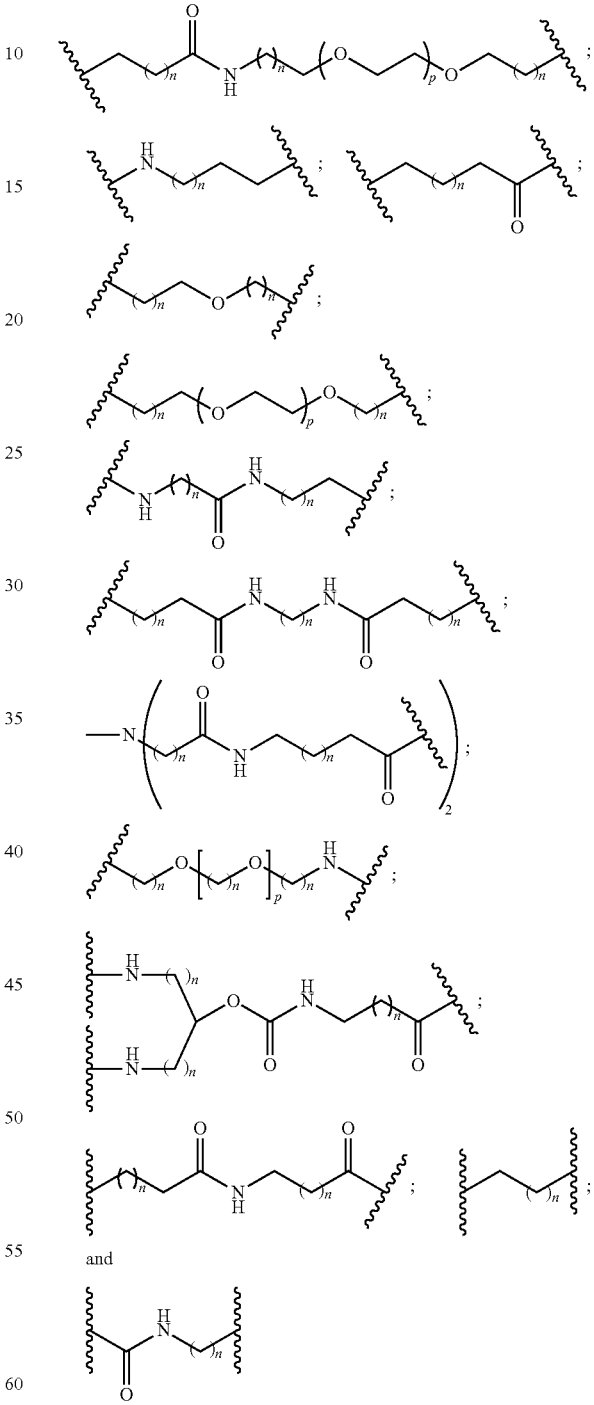

wherein each n is, independently, from 1 to 20; and
each p is from 1 to about 6.

In certain embodiments, each tether is selected from among:

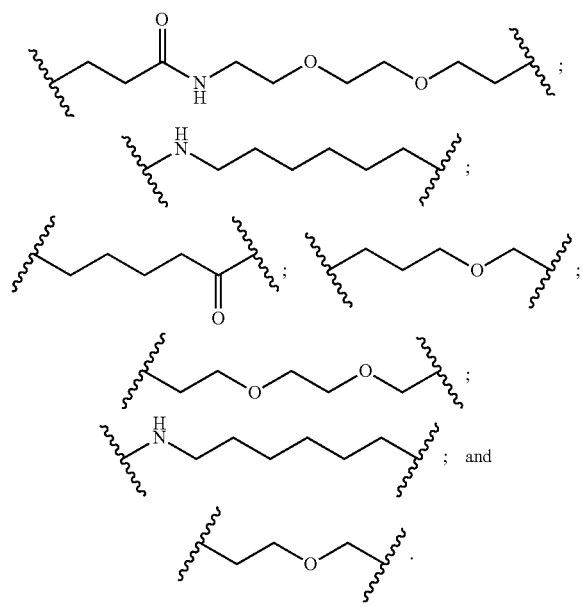

In certain embodiments, each tether has the following structure:

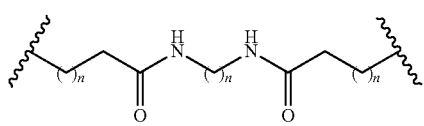

wherein each n is, independently, from 1 to 20.

In certain embodiments, each tether has the following structure:

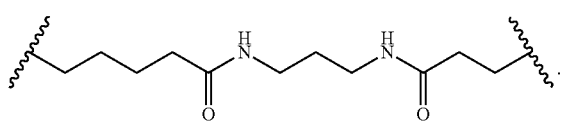 [SMILES: *CCCCC(=O)NCCCNC(=O)CC*]

In certain embodiments, the tether has a structure selected from among:

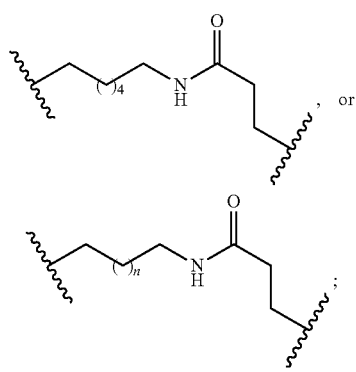

wherein each n is independently, 0, 1, 2, 3, 4, 5, 6, or 7.

In certain embodiments, the tether has a structure selected from among:

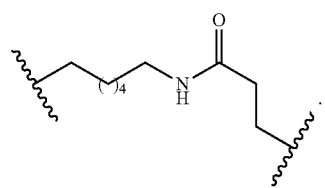

In certain embodiments, the ligand is galactose.

In certain embodiments, the ligand is mannose-6-phosphate.

In certain embodiments, each ligand is selected from among:

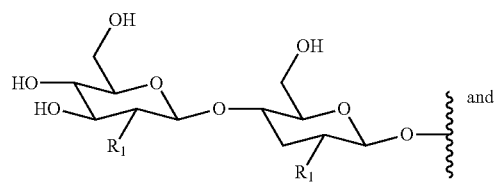

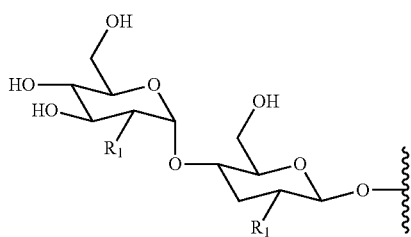

wherein each $R_1$ is selected from OH and NHCOOH.

In certain embodiments, each ligand is selected from among:

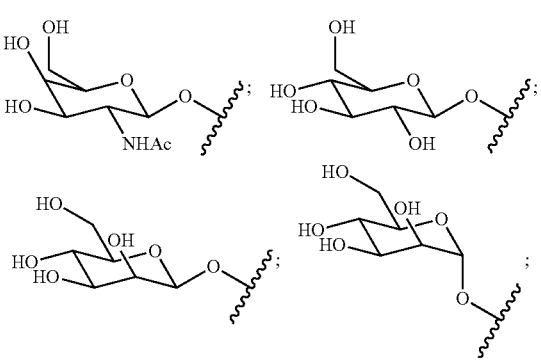

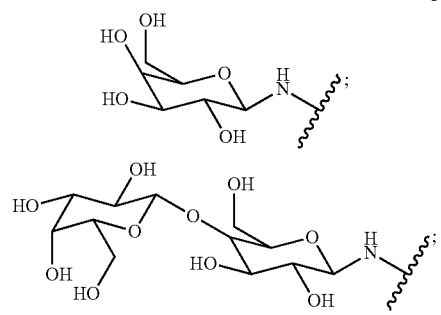

-continued

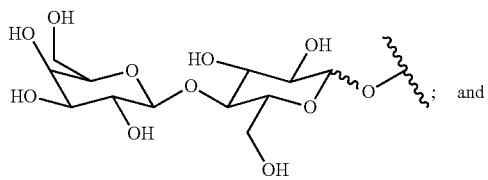
; and

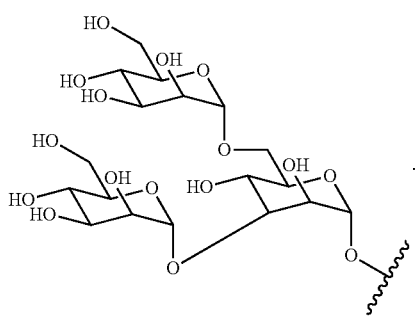

In certain embodiments, each ligand has the following structure:

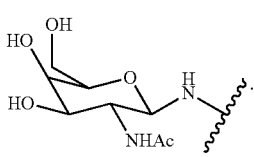 [SMILES: *NC1OC(CO)C(O)C(O)C1NC(C)=O]

In certain embodiments, each ligand has the following structure:

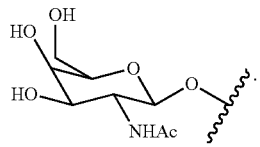 [SMILES: *OC1OC(CO)C(O)C(O)C1NC(C)=O]

In certain embodiments, the conjugate group comprises a cell-targeting moiety.

In certain embodiments, the conjugate group comprises a cell-targeting moiety having the following structure:

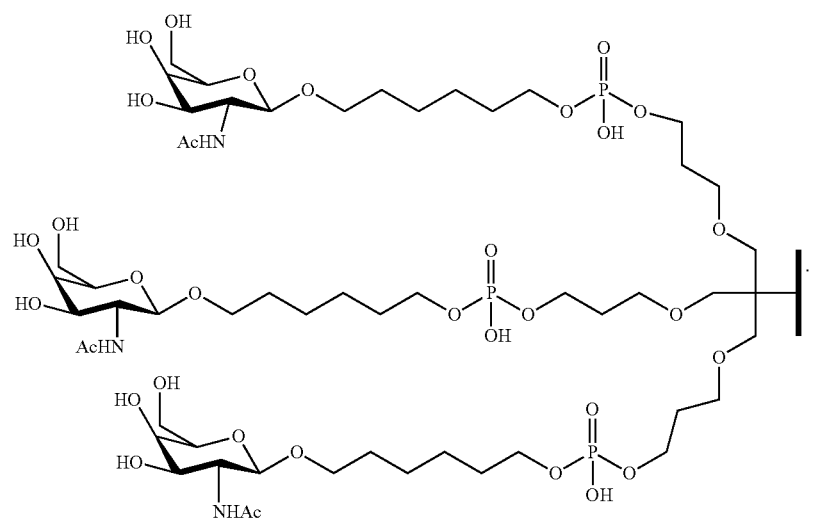

wherein each n is, independently, from 1 to 20.

In certain embodiments, the cell-targeting moiety has the following structure:

In certain embodiments, the cell-targeting moiety has the following structure:
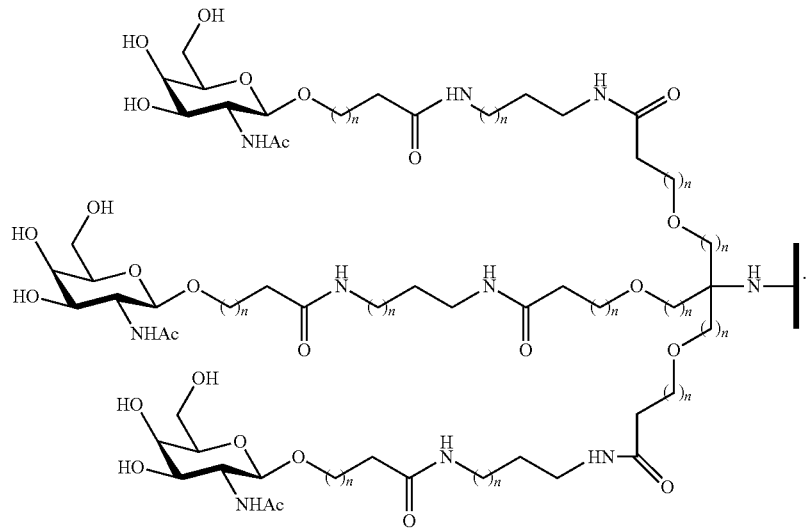
35
wherein each n is, independently, from 1 to 20.
In certain embodiments, the cell-targeting moiety has the following structure:
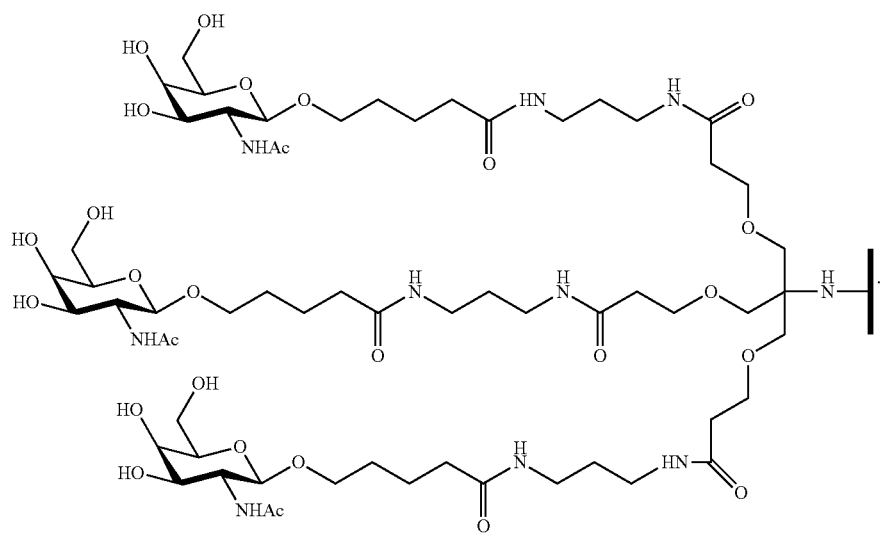

In certain embodiments, the cell-targeting moiety comprises:

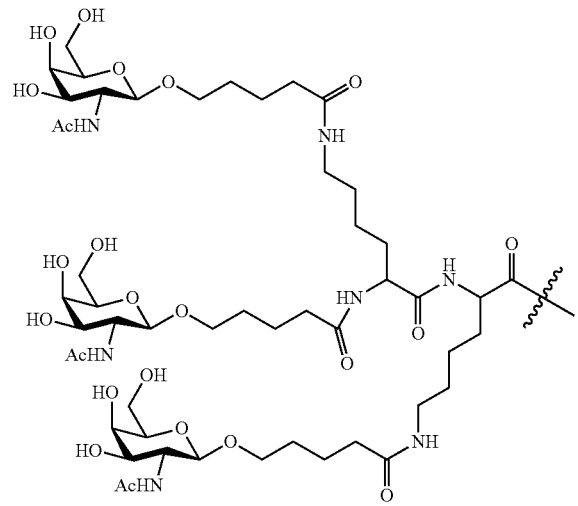

In certain embodiments, the cell-targeting moiety comprises:

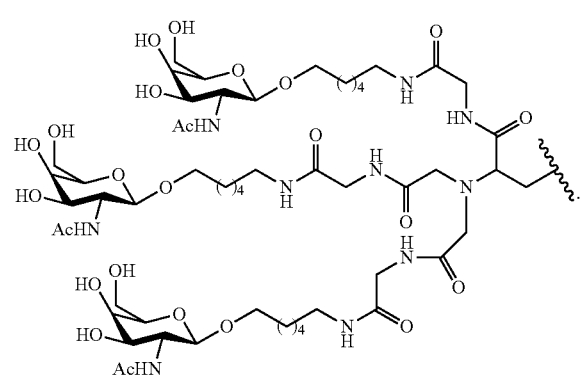

In certain embodiments, the cell-targeting moiety has the following structure:

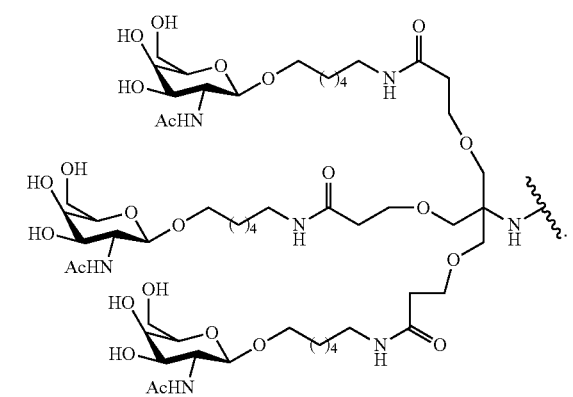

In certain embodiments, the cell-targeting moiety has the following structure:

In certain embodiments, the cell-targeting moiety comprises:

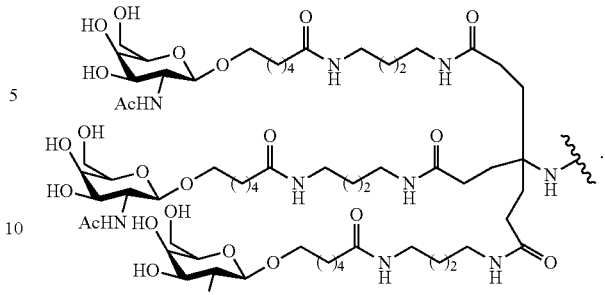

In certain embodiments, the cell-targeting moiety comprises:

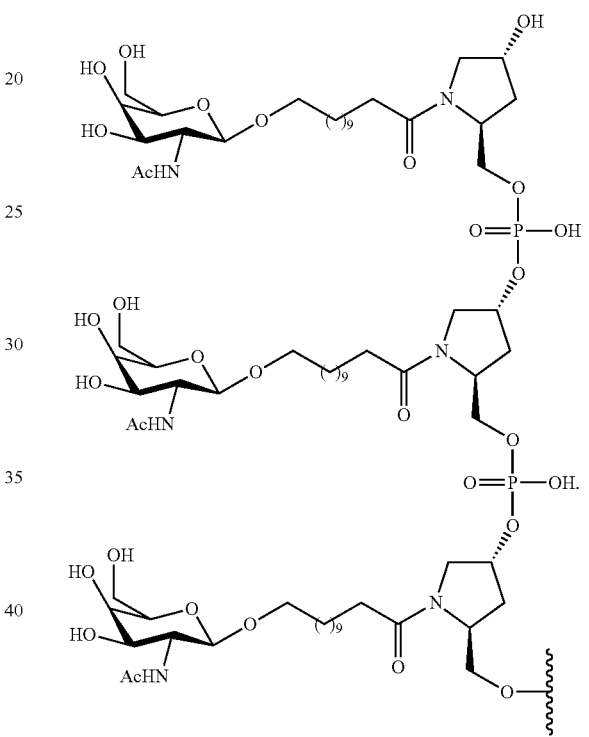

In certain embodiments, the cell-targeting moiety has the following structure:

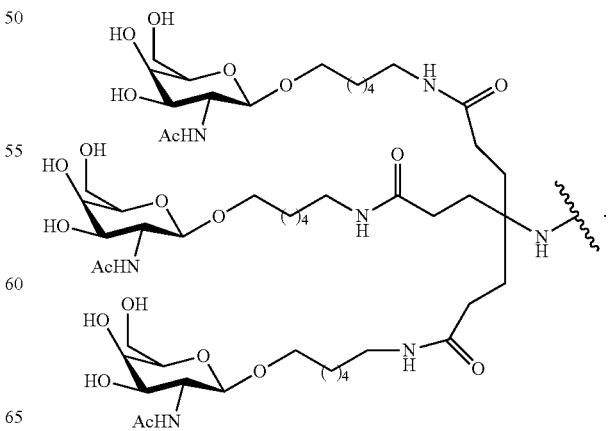

In certain embodiments, the cell-targeting moiety comprises:
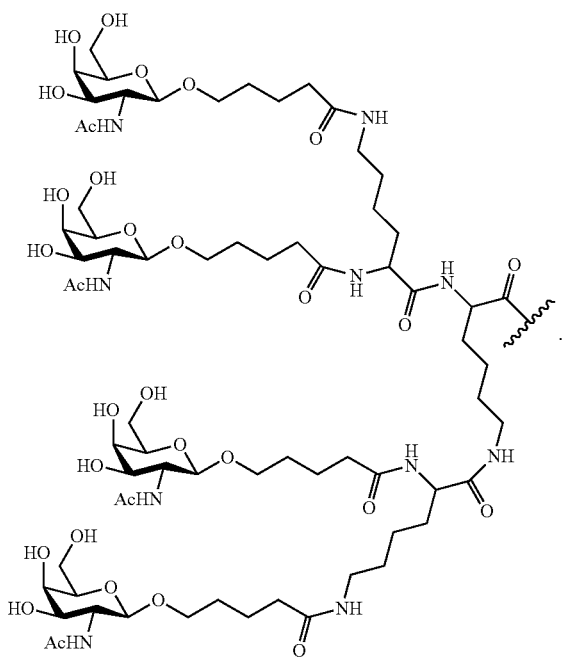
In certain embodiments, the cell-targeting moiety comprises:
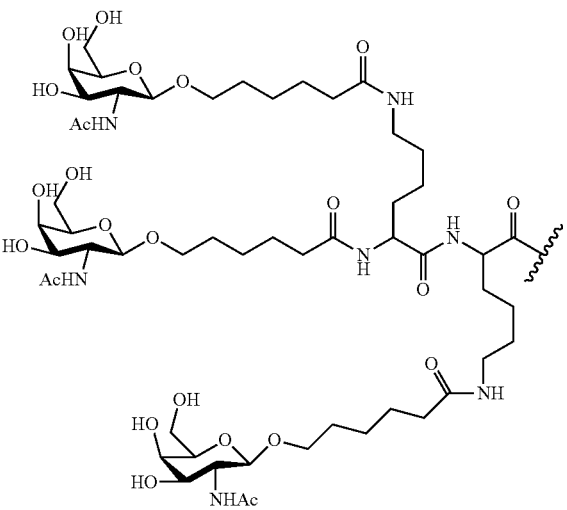
In certain embodiments, the cell-targeting moiety comprises:
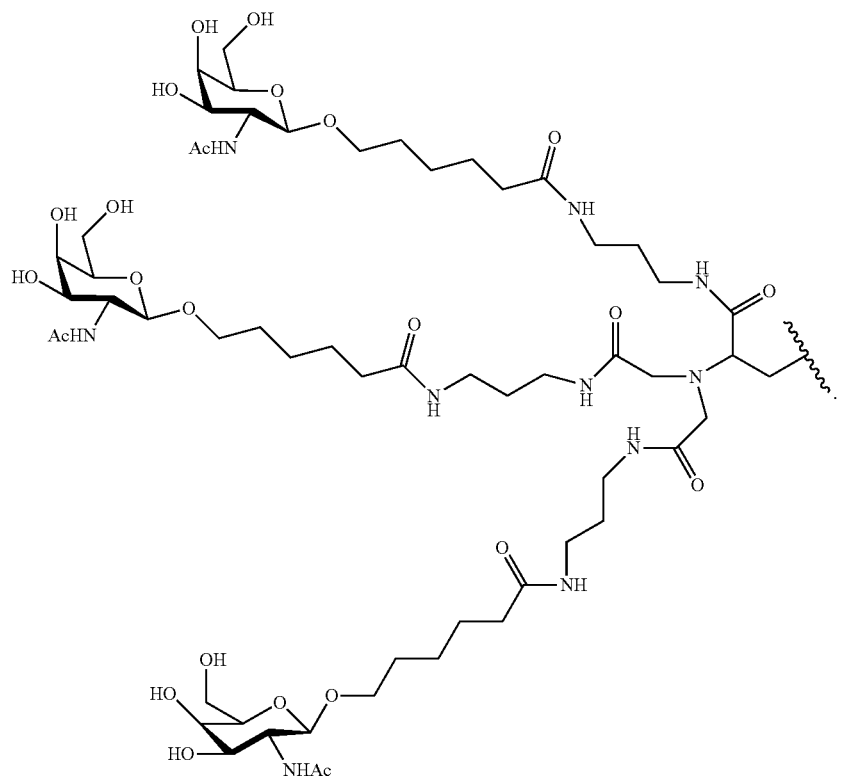

In certain embodiments, the cell-targeting moiety has the following structure:

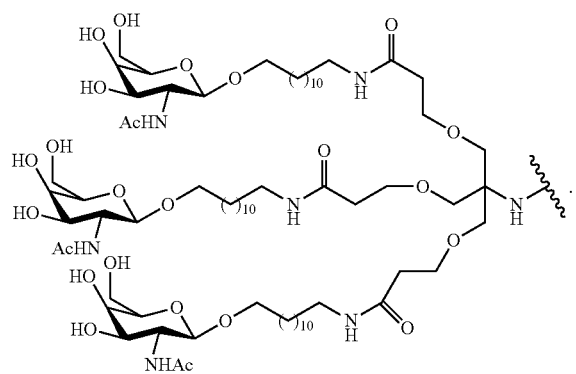

In certain embodiments, the cell-targeting moiety has the following structure:

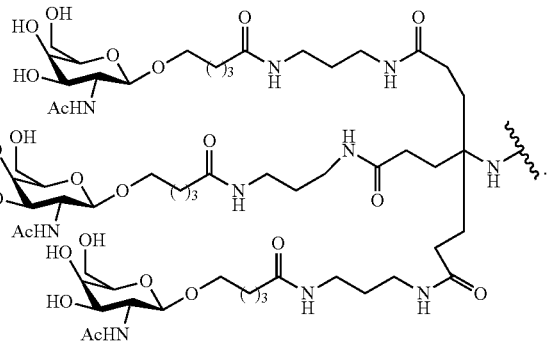

In certain embodiments, the cell-targeting moiety has the following structure:

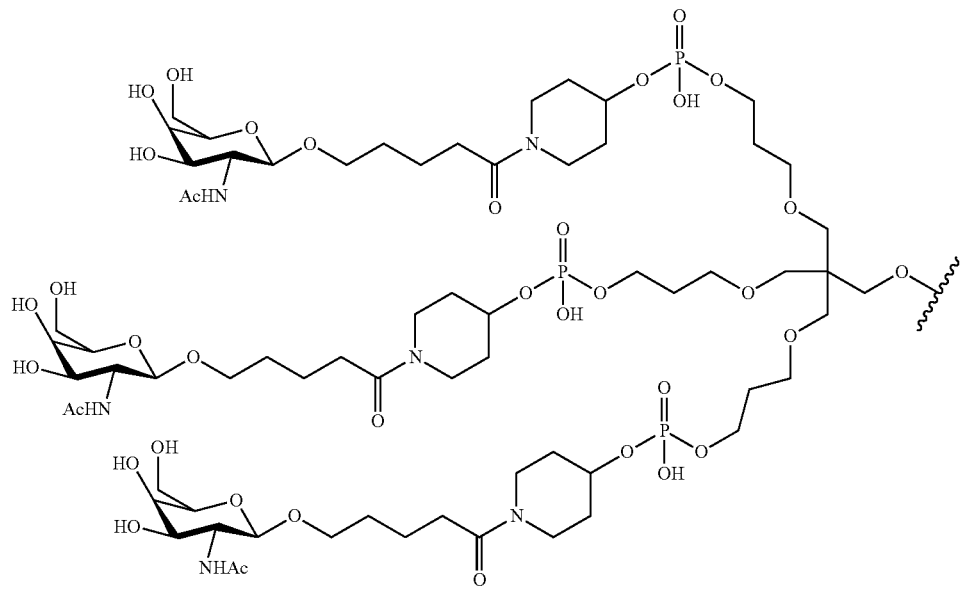

In certain embodiments, the cell-targeting moiety has the following structure:

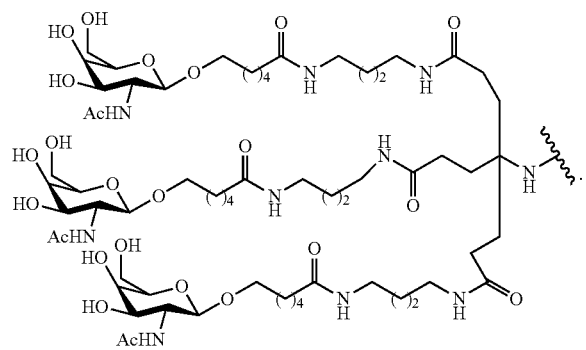

In certain embodiments, the cell-targeting moiety has the following structure:

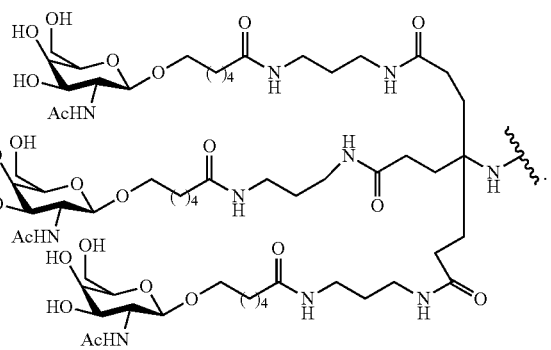

In certain embodiments, the cell-targeting moiety comprises:
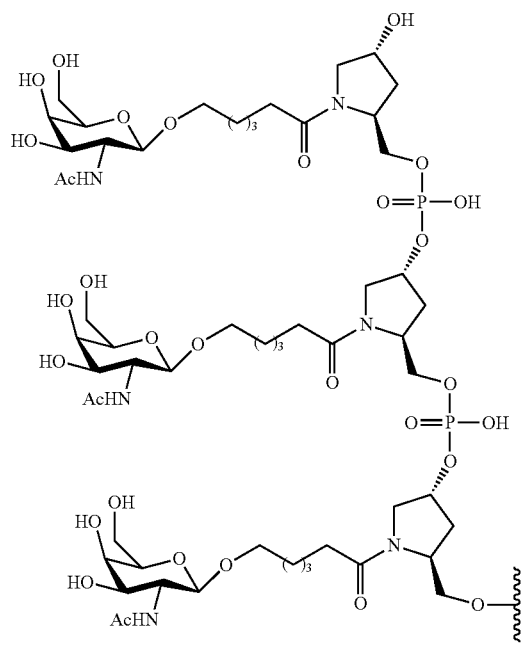
In certain embodiments, the cell-targeting moiety comprises:
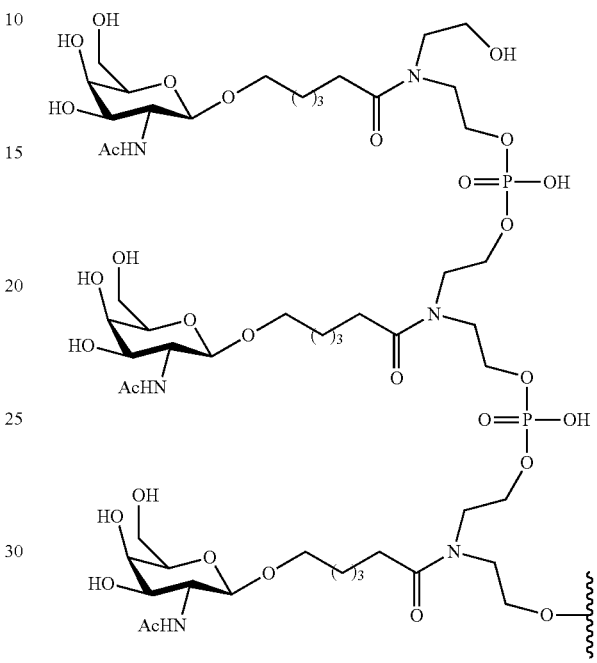
In certain embodiments, the cell-targeting moiety comprises:
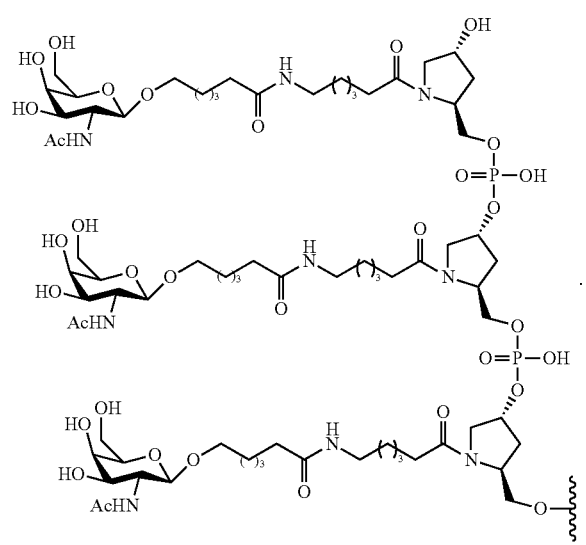
In certain embodiments, the cell-targeting moiety comprises:
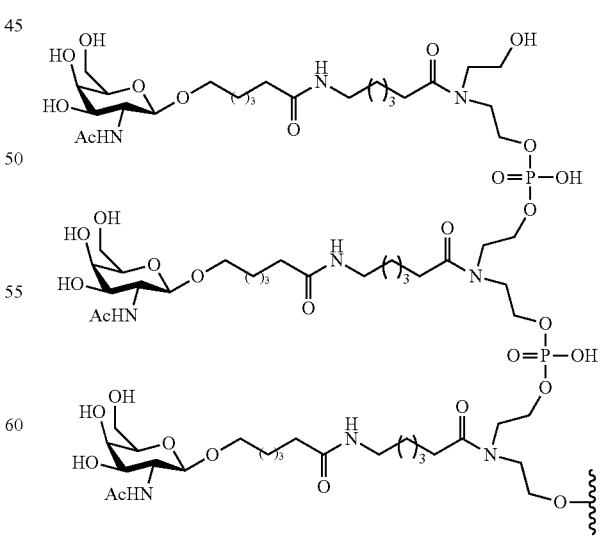

In certain embodiments, the cell-targeting moiety has the following structure:

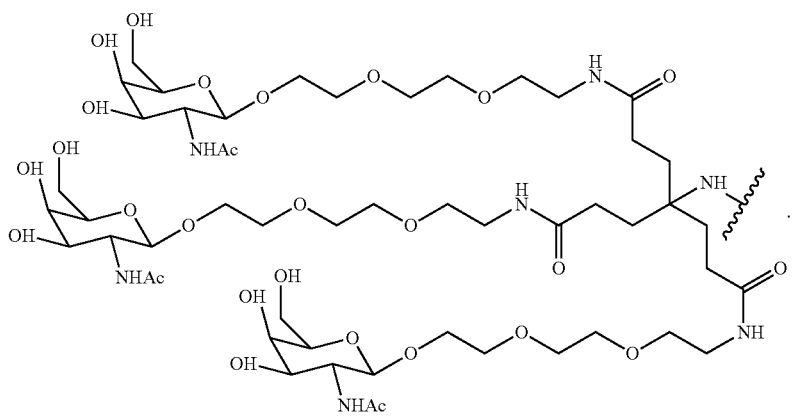 [SMILES: *NC(CCC(=O)NCCOCCOCCOC1OC(CO)C(O)C(O)C1NC(C)=O)(CCC(=O)NCCOCCOCCOC1OC(CO)C(O)C(O)C1NC(C)=O)CCC(=O)NCCOCCOCCOC1OC(CO)C(O)C(O)C1NC(C)=O]

In certain embodiments, the cell-targeting moiety comprises:

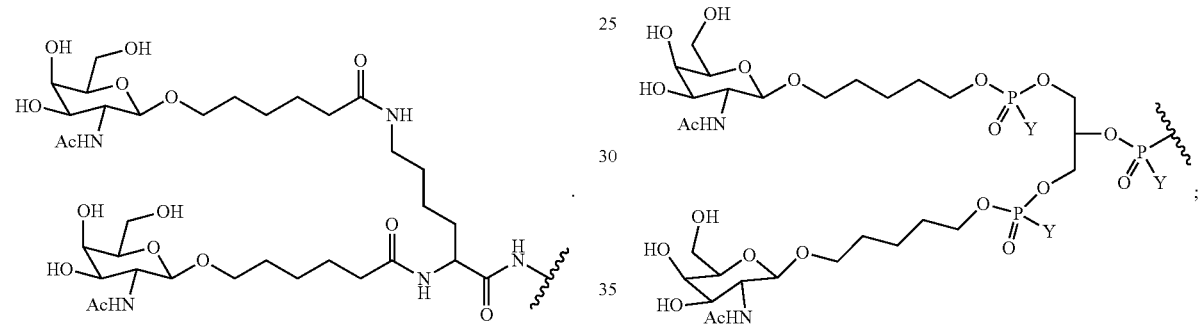

In certain embodiments, the cell-targeting moiety has the following structure:

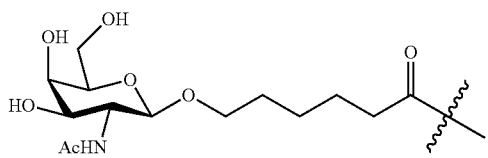

wherein each Y is selected from O, S, a substituted or unsubstituted $C_1$-$C_{10}$ alkyl, amino, substituted amino, azido, alkenyl or alkynyl.

In certain embodiments, the conjugate group comprises:

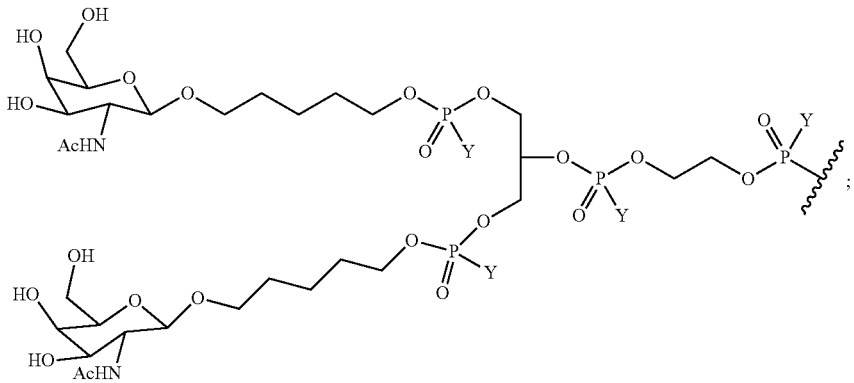

wherein each Y is selected from O, S, a substituted or unsubstituted $C_1$-$C_{10}$ alkyl, amino, substituted amino, azido, alkenyl or alkynyl.

In certain embodiments, the cell-targeting moiety has the following structure:

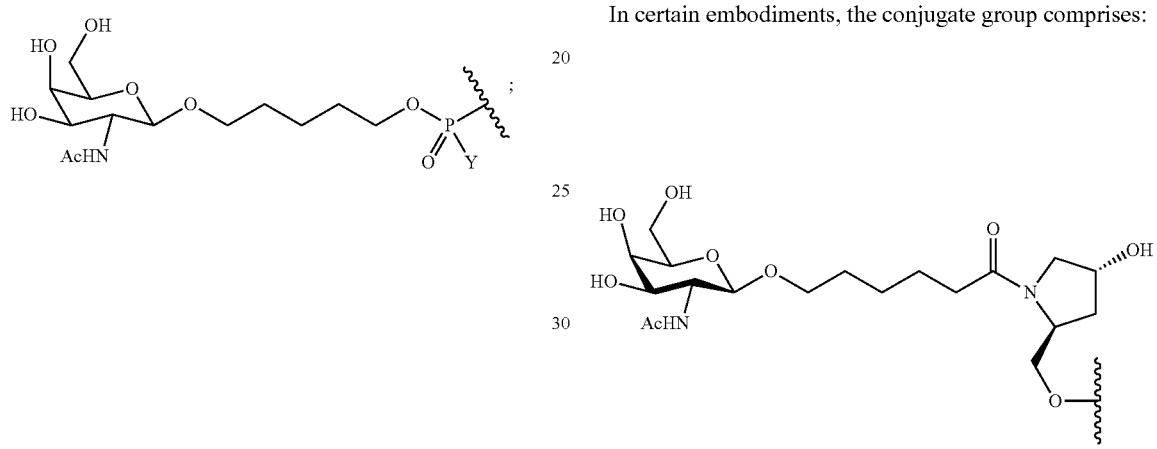

wherein each Y is selected from O, S, a substituted or unsubstituted $C_1$-$C_{10}$ alkyl, amino, substituted amino, azido, alkenyl or alkynyl.

In certain embodiments, the conjugate group comprises:

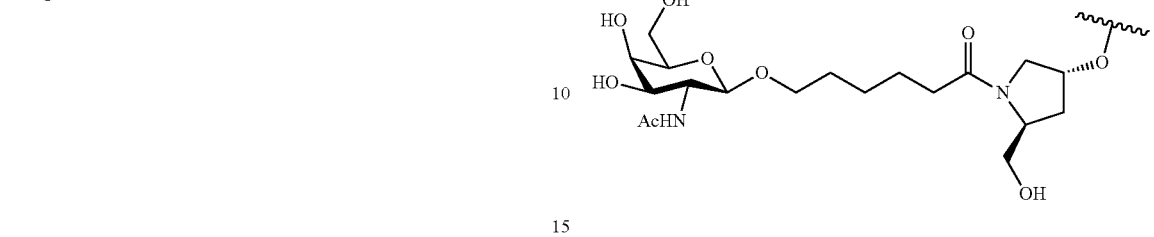

In certain embodiments, the conjugate group comprises:

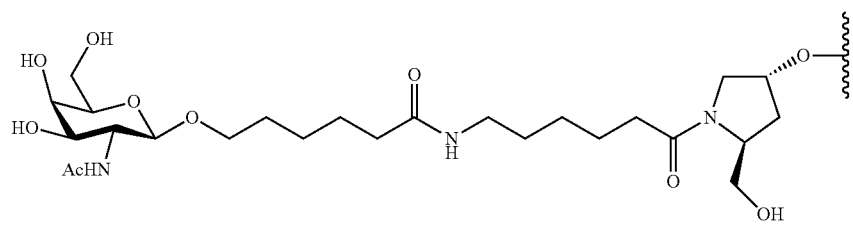

T In certain embodiments, the conjugate group comprises:

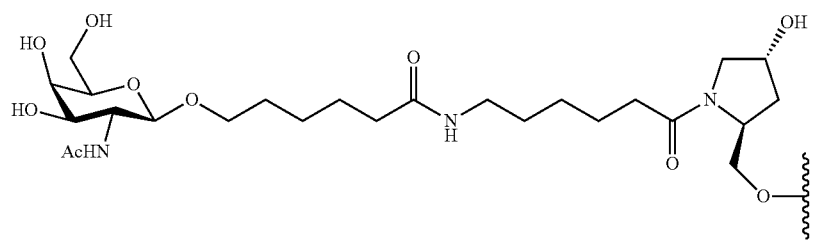

In certain embodiments, the conjugate group comprises:

In certain embodiments, the conjugate group comprises a cleavable moiety selected from among: a phosphodiester, an amide, or an ester.

In certain embodiments, the conjugate group comprises a phosphodiester cleavable moiety.

In certain embodiments, the conjugate group does not comprise a cleavable moiety, and wherein the conjugate group comprises a phosphorothioate linkage between the conjugate group and the oligonucleotide.

In certain embodiments, the conjugate group comprises an amide cleavable moiety.

In certain embodiments, the conjugate group comprises an ester cleavable moiety.

In certain embodiments, the compound has the following structure:
ke

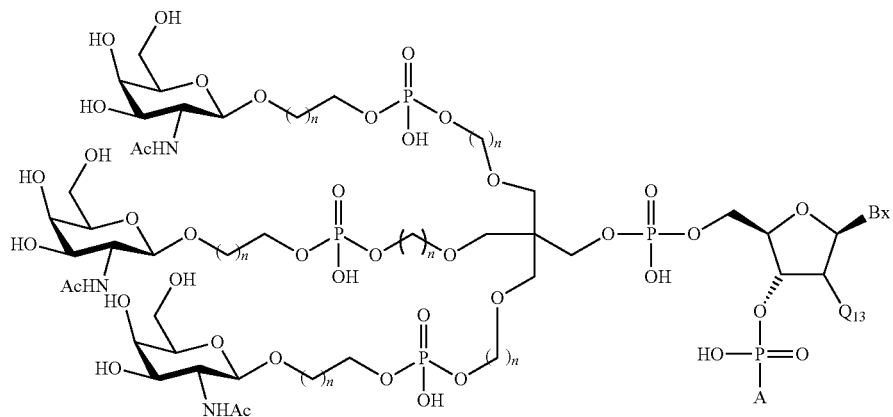

wherein each n is, independently, from 1 to 20;
$Q_{13}$ is H or $O(CH_2)_2$—$OCH_3$;
A is the modified oligonucleotide; and
Bx is a heterocyclic base moiety.

In certain embodiments, the compound has the following structure:

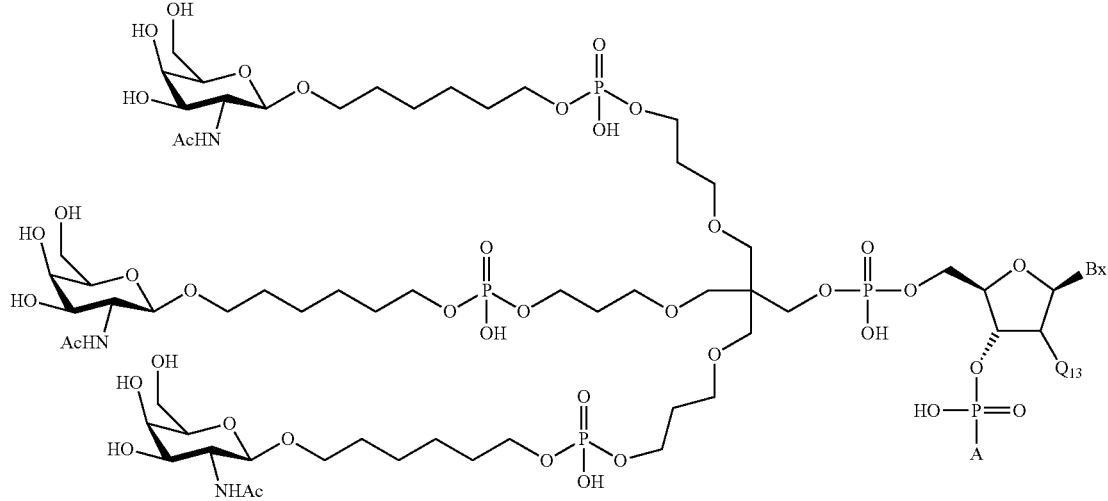

wherein each n is, independently, from 1 to 20;
Q$_{13}$ is H or O(CH$_2$)$_2$—OCH$_3$;
A is the modified oligonucleotide; and
Bx is a heterocyclic base moiety.

In certain embodiments, the compound has the following structure:

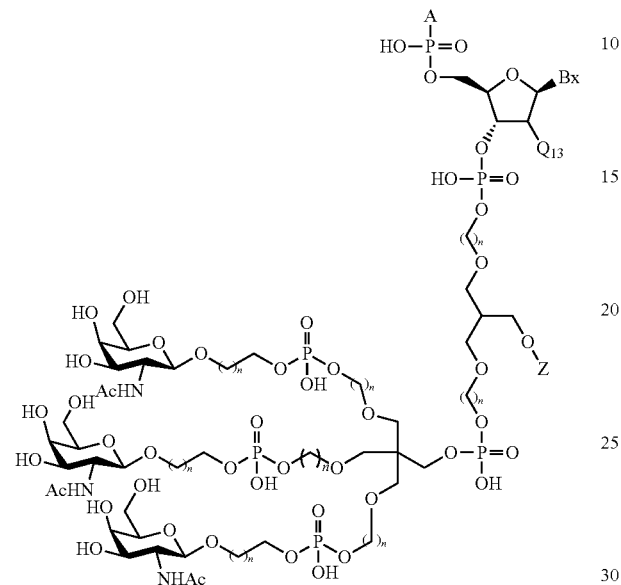

wherein each n is, independently, from 1 to 20;
Q$_{13}$ is H or O(CH$_2$)$_2$—OCH$_3$;
A is the modified oligonucleotide;
Z is H or a linked solid support; and
Bx is a heterocyclic base moiety.

In certain embodiments, the compound has the following structure:

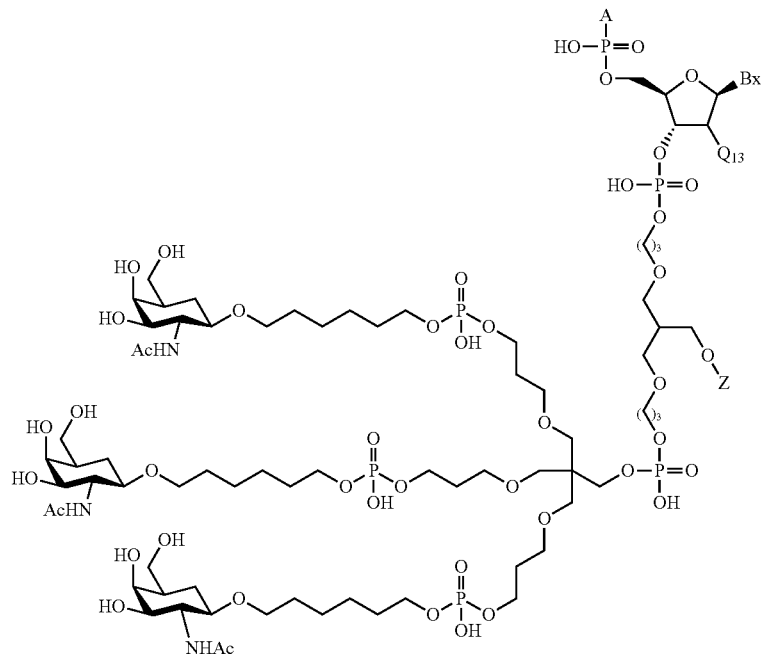

wherein each n is, independently, from 1 to 20;
$Q_{13}$ is H or $O(CH_2)_2—OCH_3$;
A is the modified oligonucleotide;
Z is H or a linked solid support; and
Bx is a heterocyclic base moiety.

In certain embodiments, the compound has the following structure:

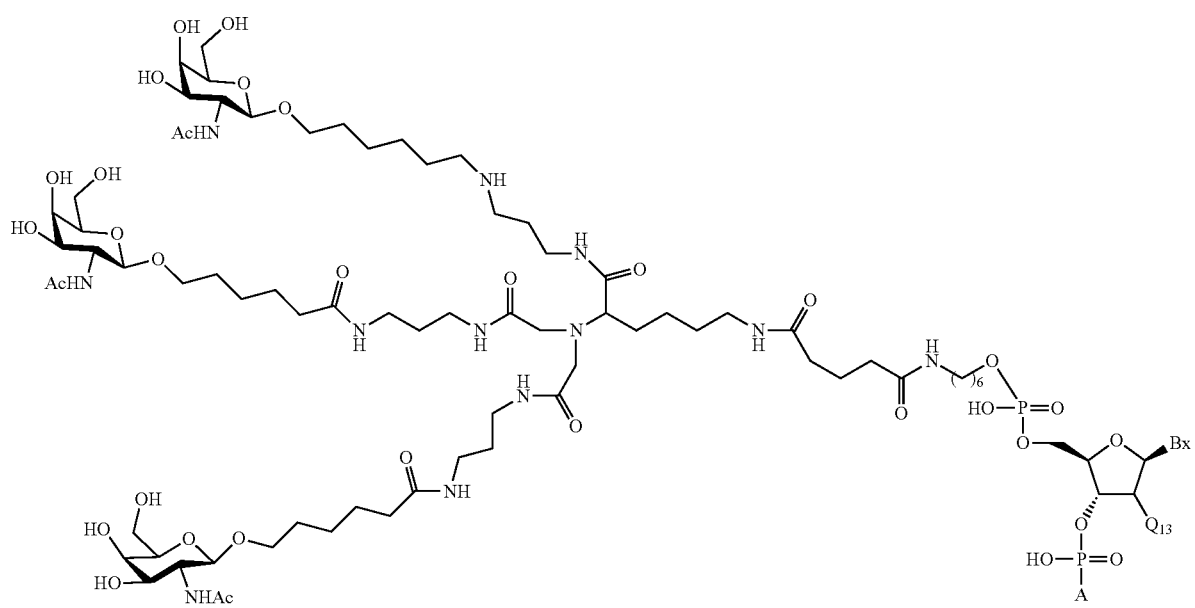

wherein $Q_{13}$ is H or $O(CH_2)_2—OCH_3$;
A is the modified oligonucleotide; and
Bx is a heterocyclic base moiety.

In certain embodiments, the compound has the following structure:

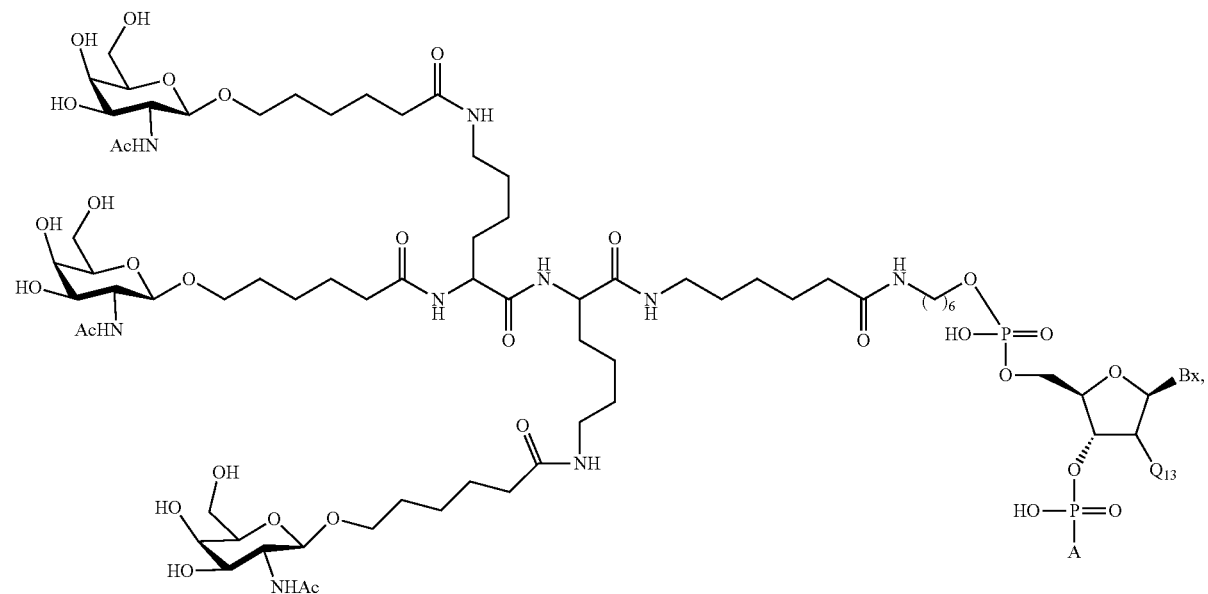

wherein $Q_{13}$ is H or $O(CH_2)_2$—$OCH_3$;
A is the modified oligonucleotide; and
Bx is a heterocyclic base moiety.
In certain embodiments, the compound has the following structure:
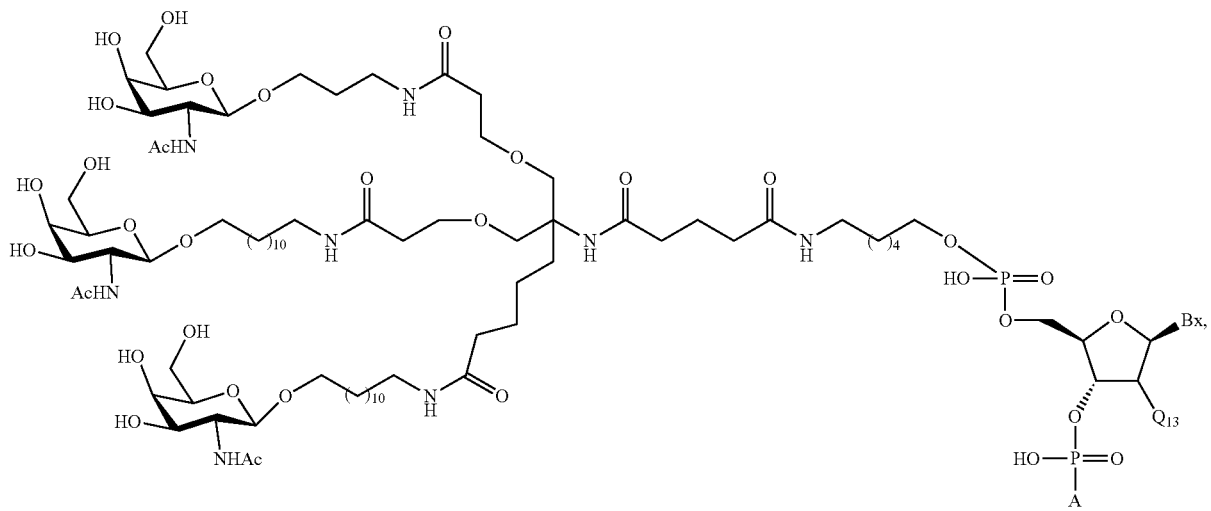
wherein $Q_{13}$ is H or $O(CH_2)_2$—$OCH_3$;
A is the modified oligonucleotide; and
Bx is a heterocyclic base moiety.
In certain embodiments, the compound has the following structure:
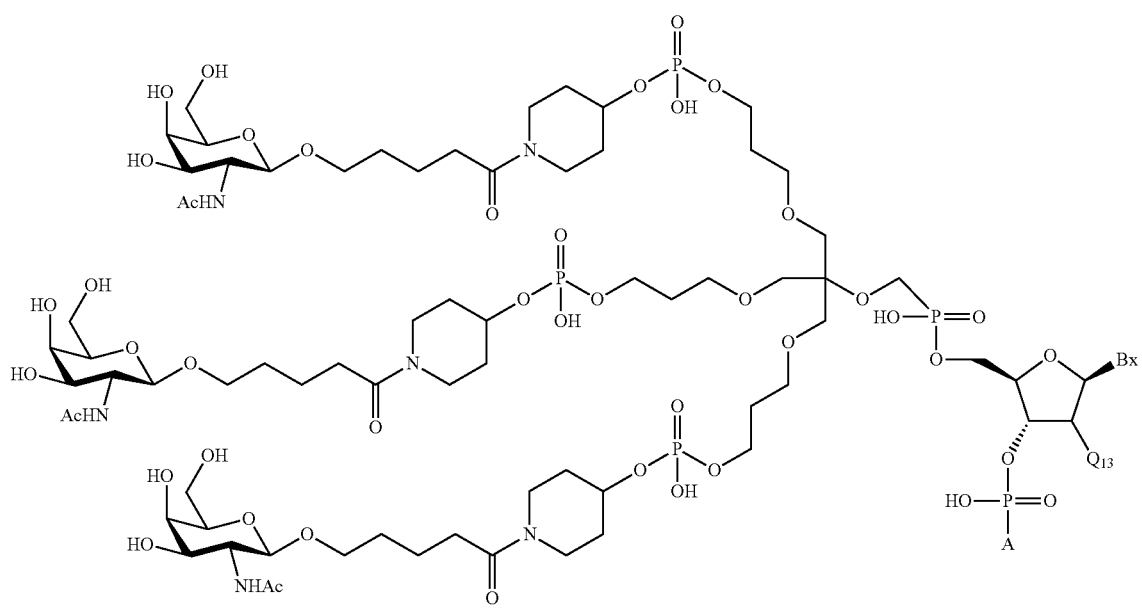

wherein $Q_{13}$ is H or $O(CH_2)_2-OCH_3$;
A is the modified oligonucleotide; and
Bx is a heterocyclic base moiety.
In certain embodiments, the compound has the following structure:
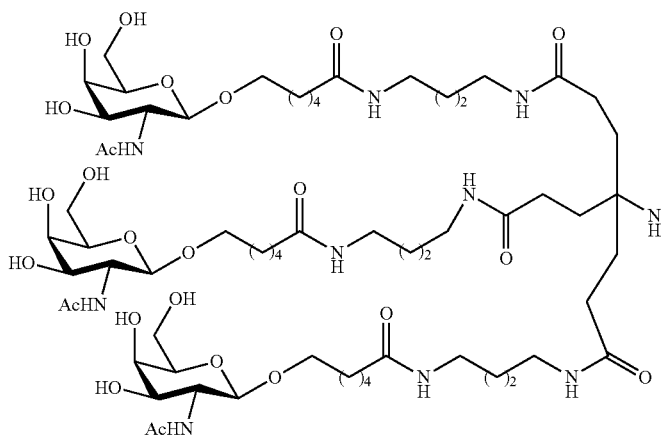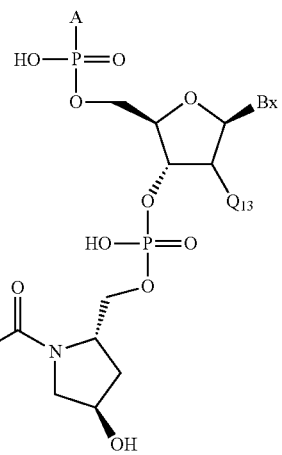
wherein $Q_{13}$ is H or $O(CH_2)_2-OCH_3$;
A is the modified oligonucleotide; and
Bx is a heterocyclic base moiety.
In certain embodiments, the compound has the following structure:
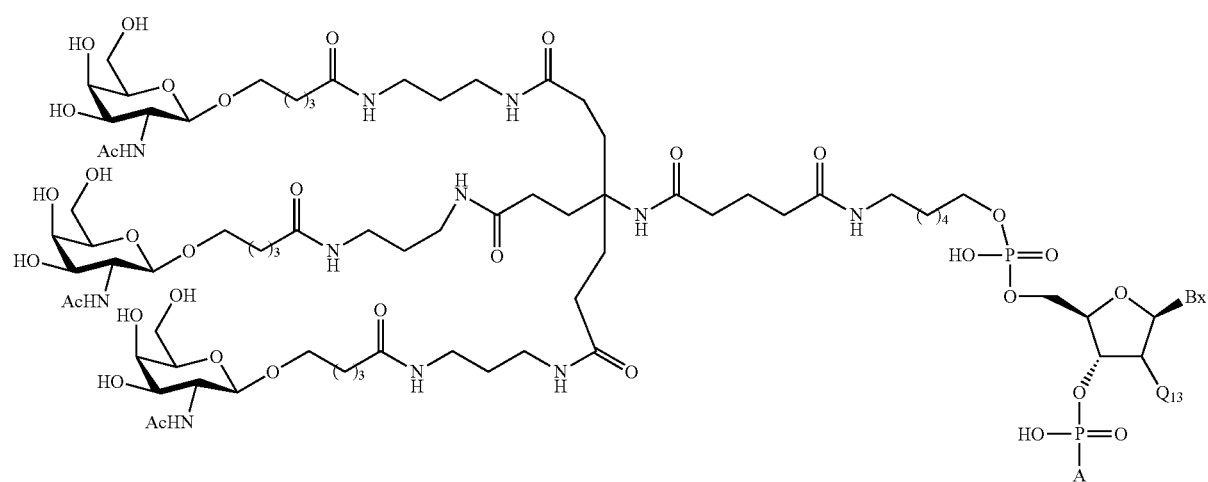

wherein $Q_{13}$ is H or $O(CH_2)_2\text{—}OCH_3$;
A is the modified oligonucleotide; and
Bx is a heterocyclic base moiety.

In certain embodiments, the compound has the following structure:

wherein $Q_{13}$ is H or $O(CH_2)_2\text{—}OCH_3$;
A is the modified oligonucleotide; and
Bx is a heterocyclic base moiety.

In certain embodiments, the compound has the following structure:

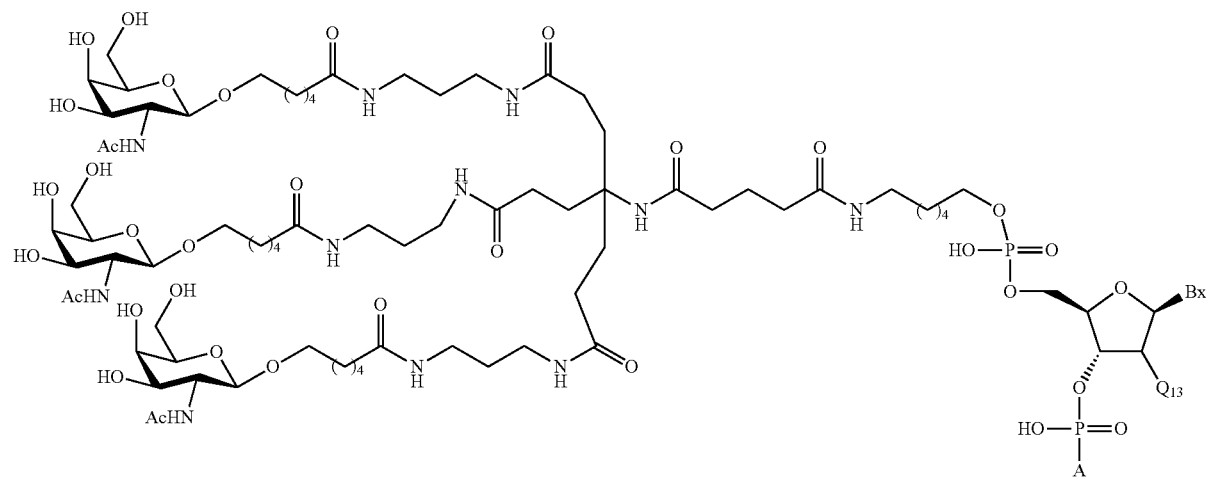

wherein $Q_{13}$ is H or $O(CH_2)_2\text{—}OCH_3$;
A is the modified oligonucleotide; and
Bx is a heterocyclic base moiety.

In certain embodiments, the compound has the following structure:

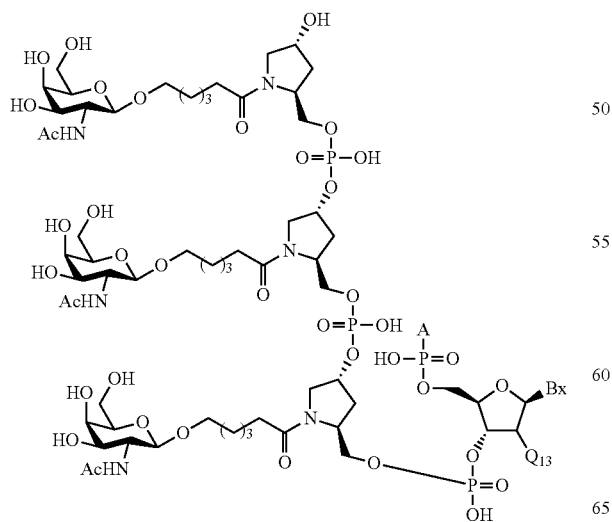

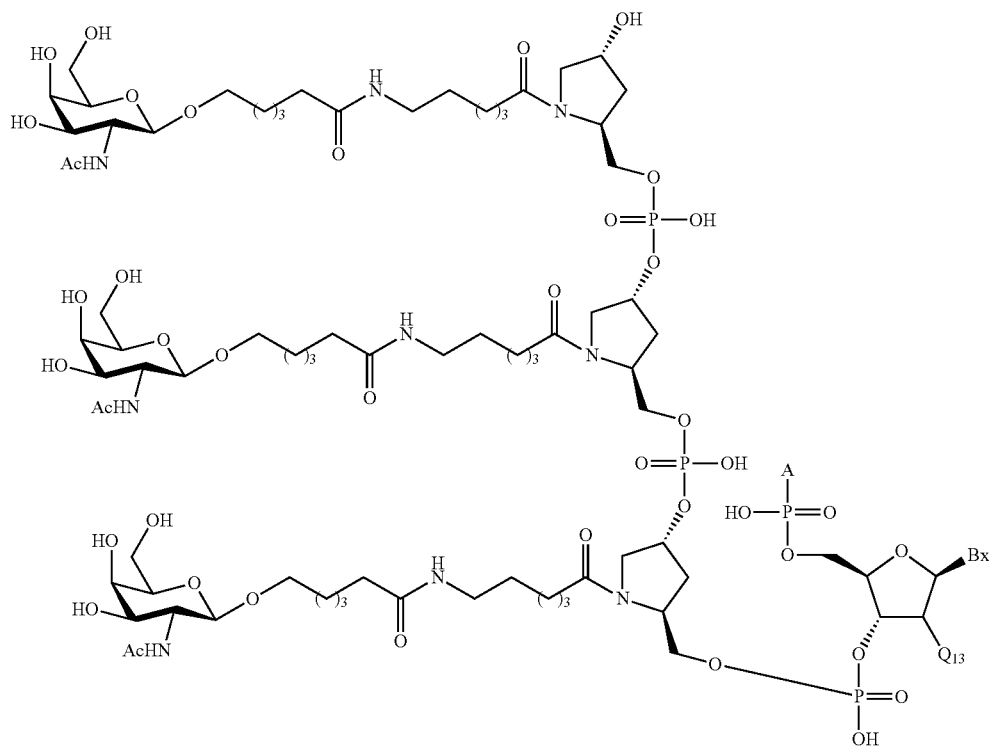
wherein $Q_{13}$ is H or $O(CH_2)_2-OCH_3$;
A is the modified oligonucleotide; and
Bx is a heterocyclic base moiety.
In certain embodiments, the compound has the following structure:
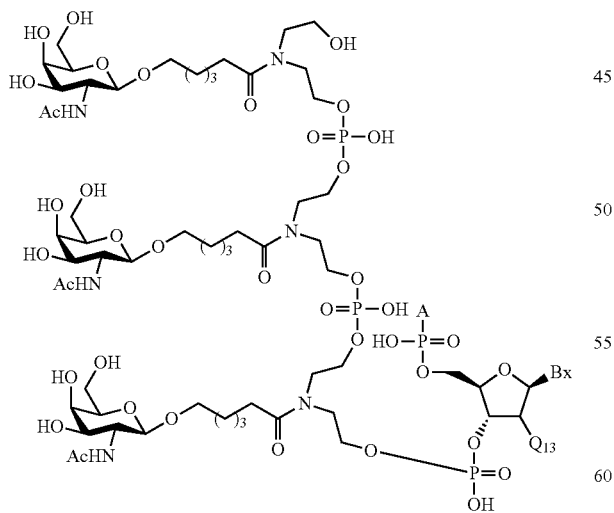
wherein $Q_{13}$ is H or $O(CH_2)_2-OCH_3$;
A is the modified oligonucleotide; and
Bx is a heterocyclic base moiety.

In certain embodiments, the compound has the following structure:
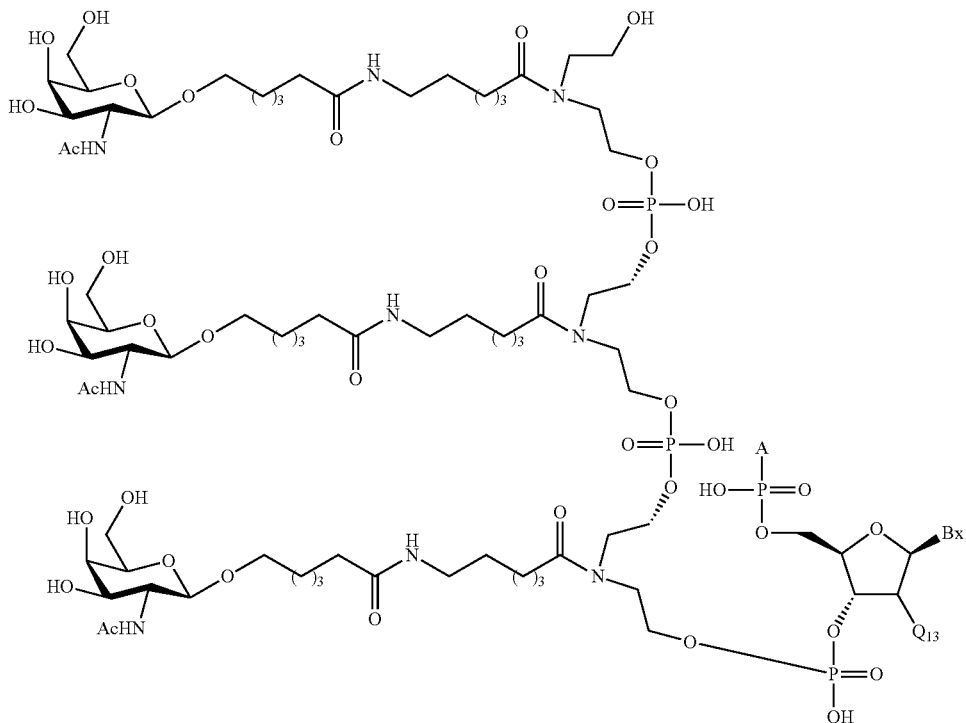
wherein $Q_{13}$ is H or $O(CH_2)_2-OCH_3$;
A is the modified oligonucleotide; and
Bx is a heterocyclic base moiety.
In certain embodiments, the conjugate group comprises:
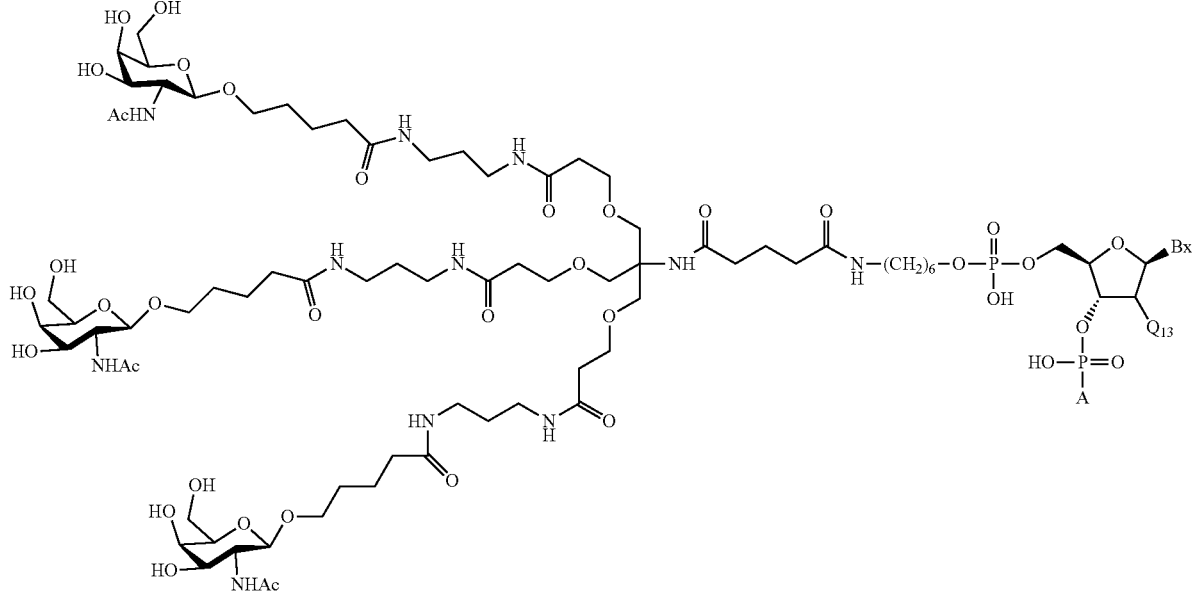

wherein $Q_{13}$ is H or $O(CH_2)_2$—$OCH_3$;
A is the modified oligonucleotide; and
$B_x$ is a heterocyclic base moiety.
In certain embodiments, the conjugate group comprises:

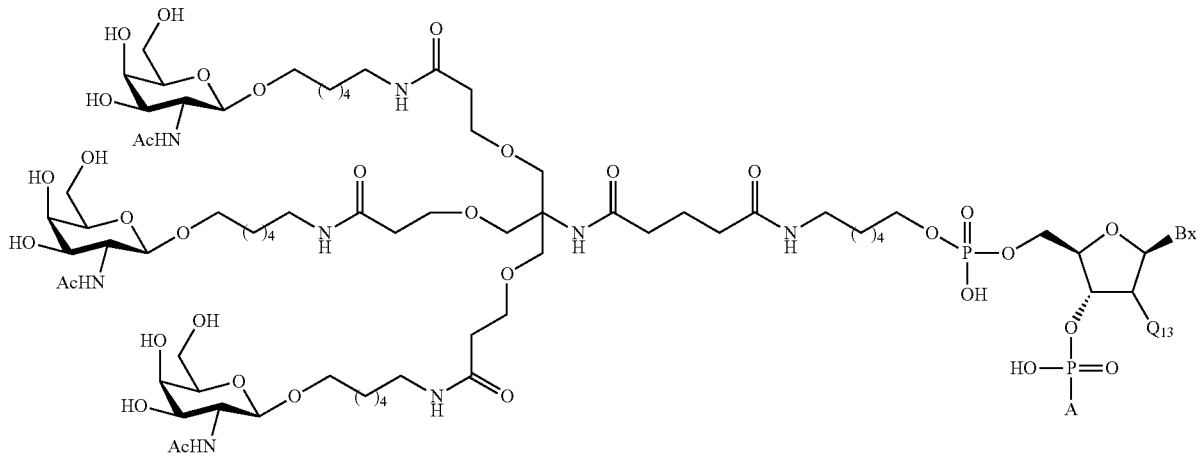

wherein $Q_{13}$ is H or $O(CH_2)_2$—$OCH_3$;
A is the modified oligonucleotide; and
$B_x$ is a heterocyclic base moiety.
In certain embodiments, the conjugate group comprises:

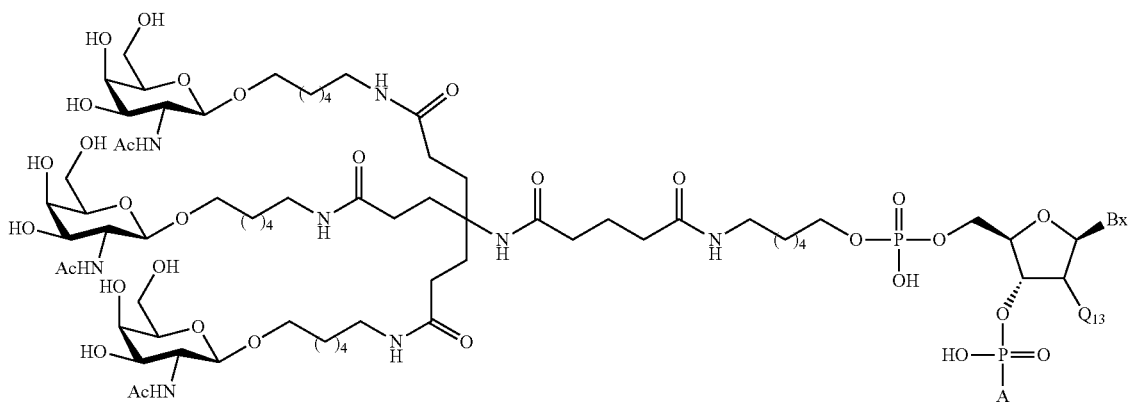

wherein $Q_{13}$ is H or $O(CH_2)_2$—$OCH_3$;
A is the modified oligonucleotide; and
$B_x$ is a heterocyclic base moiety.

In certain embodiments, $B_x$ is selected from among from adenine, guanine, thymine, uracil, or cytosine, or 5-methyl cytosine. In certain embodiments, $B_x$ is adenine. In certain embodiments, $B_x$ is thymine. In certain embodiments, $Q_{13}$ is $O(CH_2)_2$—$OCH_3$. In certain embodiments, $Q_{13}$ is H.

Certain embodiments of the invention provide a prodrug comprising the compositions or compounds disclosed herein. Certain embodiments provide methods of using the conjugated antisense compounds and compositions described herein for inhibiting ANGPTL3 expression. In certain embodiments, the conjugated antisense compounds or compositions inhibit ANGPTL3 by at least 5%, at least 10%, at least 20%, at least 30%, at least 35%, at least 40%, at least 45%, at least 50%, at least 55%, at least 60%, at least 65%, at least 70%, at least 75%, at least 80%, at least 85%, at least 90% or at least 95%. In a preferred embodiment, the antisense compound comprising a modified oligonucleotide and a conjugate group decreases ANGPTL3 by at least 50%. In a preferred embodiment, the antisense compound comprising a modified oligonucleotide and a conjugate group decreases ANGPTL3 by at least 55%. In a preferred embodiment the antisense compound comprising a modified oligonucleotide and a conjugate group decreases ANGPTL3 by at least 60%. In a preferred embodiment, the antisense compound comprising a modified oligonucleotide and a conjugate group decreases ANGPTL3 by at least 65%. In a preferred embodiment, the antisense compound comprising a modified oligonucleotide and a conjugate group decreases ANGPTL3 by at least 70%. In a preferred embodiment, the antisense compound comprising a modified oligonucleotide and a conjugate group decreases ANGPTL3 by at least 75%. In a preferred embodiment, the antisense compound comprising a modified oligonucleotide and a conjugate group decreases ANGPTL3 by at least 80%. In a preferred embodiment, the antisense compound comprising a modified oligonucleotide and a conjugate group decreases ANGPTL3 by at least 85%. In a preferred embodiment, the antisense compound comprising a modified oligonucleotide and a conjugate group decreases ANGPTL3 by at least 90%. In a preferred embodiment, the antisense compound comprising a modified oligonucleotide and a conjugate group decreases ANGPTL3 by at least 95%.

In certain embodiments, the conjugated antisense compounds or compositions disclosed herein have an $IC_{50}$ of less than 20 µM, less than 10 µM, less than 8 µM, less than 5 µM, less than 2 µM, less than 1 µM, or less than 0.8 µM, when tested human cells, for example, in the Hep3B cell line as described in Examples 2-3 and 7-10.

In certain embodiments, the conjugated antisense compounds or compositions disclosed herein are efficacious by virtue of having a viscosity of less than 40 cP, less than 35 cP, less than 30 cP, less than 25 cP, less than 20 cP or less than 15 cP when measured by the parameters as described in Example 13.

In certain embodiments, the conjugated antisense compounds or compositions disclosed herein are highly tolerable, as demonstrated by the in vivo tolerability measurements described in the examples. In certain embodiments, the conjugated antisense compounds as described herein are highly tolerable, as demonstrated by having an increase in ALT and/or AST value of no more than 4 fold, 3 fold, 2 fold or 1.5 fold over saline treated animals.

Certain embodiments disclosed herein provide a salt of the conjugated antisense compounds disclosed herein. In certain embodiments, the compounds or compositions disclosed herein comprise a salt of the modified oligonucleotide with the conjugate group.

In certain embodiments, the conjugated antisense compounds or compositions disclosed herein further comprise a pharmaceutically acceptable carrier or diluent.

In certain embodiments, the animal is a human.

Certain embodiments disclosed herein provide methods comprising administering to an animal the conjugated antisense compounds or compositions disclosed herein. In certain embodiments, administering the conjugated antisense compound or composition is therapeutic. In certain embodiments, administering the conjugated antisense compound or composition treats, prevents, or slows progression of a disease related to ANGPTL3. In certain embodiments, the disease is related to elevated ANGPTL3. In certain embodiments, administering the conjugated antisense compound or composition prevents, treats, ameliorates, or slows progression of a cardiovascular and/or metabolic disease.

Certain embodiments disclosed herein provide methods for treating a human with a cardiovascular and/or metabolic disease comprising identifying a human with cardiovascular and/or metabolic disease and administering to the human a therapeutically effective amount of any of the conjugated antisense compounds or compositions disclosed herein, so as to treat the human for cardiovascular and/or metabolic disease.

Certain embodiments provide conjugated antisense compounds and compositions described herein for use in therapy. In certain embodiments, the therapy is used in treating, preventing, or slowing progression of a disease related to ANGPTL3. In certain embodiments, the therapy is used in treating, preventing, or slowing progression of a disease related to elevated ANGPTL3.

In certain embodiments, the disease is a cardiovascular and/or metabolic disease, disorder or condition. In certain embodiments, the metabolic and/or cardiovascular disease includes, but is not limited to, obesity, diabetes, insulin resistance, atherosclerosis, dyslipidemia, lipodystrophy, coronary heart disease, non-alcoholic fatty liver disease (NAFLD), nonalcoholic steatohepatitis (NASH) hyperfattyacidemia or metabolic syndrome, or a combination thereof. The dyslipidemia can be hyperlipidemia. The hyperlipidemia can be combined hyperlipidemia (CHL), hypercholesterolemia, hypertriglyceridemia, or both hypercholesterolemia and hypertriglyceridemia. The combined hyperlipidemia can be familial or non-familial. The hypercholesterolemia can be familial homozygous hypercholesterolemia (HoFH), familial heterozygous hypercholesterolemia (HeFH). The hypertriglyceridemia can be familial chylomicronemia syndrome (FCS) or hyperlipoproteinemia Type IV. The NAFLD can be hepatic steatosis or steatohepatitis. The diabetes can be type 2 diabetes or type 2 diabetes with dyslipidemia. The insulin resistance can be insulin resistance with dyslipidemia.

In certain embodiments, the conjugated antisense compounds or compositions disclosed herein are designated as a first agent and the methods or uses disclosed herein further comprise administering a second agent. In certain embodiments, the first agent and the second agent are co-administered. In certain embodiments the first agent and the second agent are co-administered sequentially or concomitantly.

In certain embodiments, the second agent is a glucose-lowering agent. The glucose lowering agent can include, but is not limited to, a therapeutic lifestyle change, PPAR agonist, a dipeptidyl peptidase (IV) inhibitor, a GLP-1 analog, insulin or an insulin analog, an insulin secretagogue, a SGLT2 inhibitor, a human amylin analog, a biguanide, an alpha-glucosidase inhibitor, or a combination thereof. The glucose-lowering agent can include, but is not limited to metformin, sulfonylurea, rosiglitazone, meglitinide, thiazolidinedione, alpha-glucosidase inhibitor or a combination thereof. The sulfonylurea can be acetohexamide, chlorpropamide, tolbutamide, tolazamide, glimepiride, a glipizide, a glyburide, or a gliclazide. The meglitinide can be nateglinide or repaglinide. The thiazolidinedione can be pioglitazone or rosiglitazone. The alpha-glucosidase can be acarbose or miglitol.

In certain embodiments, the second agent is a lipid-lowering therapy. In certain embodiments the lipid lowering therapy can include, but is not limited to, a therapeutic lifestyle change, HMG-CoA reductase inhibitor, cholesterol absorption inhibitor, MTP inhibitor (e.g., a small molecule, polypeptide, antibody or antisense compound targeted to MTP), ApoB inhibitor (e.g., a small molecule, polypeptide, antibody or antisense compound targeted to ApoB), ApoC3 inhibitor (e.g., a small molecule, polypeptide, antibody or antisense compound targeted to ApoC3), PCSK9 inhibitor (e.g., a small molecule, polypeptide, antibody or antisense compound targeted to PCSK9), CETP inhibitor (e.g., a small molecule, polypeptide, antibody or antisense compound targeted to CETP), fibrate, beneficial oil (e.g., krill or fish oils (e.g., Vascepa$^R$), flaxseed oil, or other oils rich in omega-3 fatty acids such as α-linolenic acid (ALA), docosahexaenoic acid (DHA) or eicosapentaenoic acid (EPA)), or any combination thereof. The HMG-CoA reductase inhibitor can be atorvastatin, rosuvastatin, fluvastatin, lovastatin, pravastatin, or simvastatin. The cholesterol absorption inhibitor can be ezetimibe. The fibrate can be fenofibrate, bezafibrate, ciprofibrate, clofibrate, gemfibrozil and the like.

In certain embodiments, administration comprises parenteral administration. In certain embodiments, administration comprises subcutaneous administration.

In certain embodiments, administering a conjugated antisense compound disclosed herein results in a reduction of lipid levels, including triglyceride levels, cholesterol levels, insulin resistance, glucose levels or a combination thereof. One or more of the levels can be independently reduced by at least 5%, at least 10%, at least 20%, at least 30%, at least 35%, at least 40%, at least 45%, at least 50%, at least 55%, at least 60%, at least 65%, at least 70%, at least 75%, at least 80%, at least 85%, at least 90% or at least 95%. Administering the conjugated antisense compound can result in improved insulin sensitivity or hepatic insulin sensitivity. Administering the conjugated antisense compound disclosed herein can result in a reduction in atherosclerotic plaques, obesity, glucose, lipids, glucose resistance, cholesterol, or improvement in insulin sensitivity or any combination thereof.

Certain embodiments provide the use of a conjugated antisense compound as described herein in the manufacture of a medicament for treating, ameliorating, delaying or preventing one or more of a disease related to ANGPTL3. Certain embodiments provide the use of a conjugated antisense compound as described herein in the manufacture of a medicament for treating, ameliorating, delaying or preventing one or more of a metabolic disease or a cardiovascular disease.

Certain embodiments provide a kit for treating, preventing, or ameliorating one or more of a metabolic disease or a cardiovascular disease as described herein wherein the kit comprises: a) a conjugated antisense compound as described herein; and optionally b) an additional agent or therapy as described herein. The kit can further include instructions or a label for using the kit to treat, prevent, or ameliorate one or more of a metabolic disease or a cardiovascular disease.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound can be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to ANGPTL3 nucleic acid is 10 to 30 nucleotides in length. In other words, antisense compounds are from 10 to 30 linked nucleobases. In other embodiments, the antisense compound comprises a modified oligonucleotide consisting of 8 to 80, 10 to 80, 12 to 50, 12 to 30, 15 to 30, 18 to 24, 19 to 22, or 20 linked nucleobases. In certain such embodiments, the antisense compound comprises a modified oligonucleotide consisting of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked nucleobases in length, or a range defined by any two of the above values.

In certain embodiments, the antisense compound comprises a shortened or truncated modified oligonucleotide. The shortened or truncated modified oligonucleotide can have a single nucleoside deleted from the 5' end (5' truncation), or alternatively from the 3' end (3' truncation). A shortened or truncated oligonucleotide can have two or more nucleosides deleted from the 5' end, or alternatively can have two or more nucleosides deleted from the 3' end. Alternatively, the deleted nucleosides can be dispersed throughout the modified oligonucleotide, for example, in an antisense compound having one or more nucleoside deleted from the 5' end and one or more nucleoside deleted from the 3' end.

When a single additional nucleoside is present in a lengthened oligonucleotide, the additional nucleoside can be located at the 5', 3' end or central portion of the oligonucleotide. When two or more additional nucleosides are present, the added nucleosides can be adjacent to each other, for example, in an oligonucleotide having two nucleosides added to the 5' end (5' addition), or alternatively to the 3' end (3' addition) or the central portion, of the oligonucleotide. Alternatively, the added nucleoside can be dispersed throughout the antisense compound, for example, in an oligonucleotide having one or more nucleoside added to the 5' end, one or more nucleoside added to the 3' end, and/or one or more nucleoside added to the central portion.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Certain Antisense Compound Motifs and Mechanisms

In certain embodiments, antisense compounds have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may confer another desired property e.g., serve as a substrate for the cellular endonuclease RNase H, which cleaves the RNA strand of an RNA:DNA duplex.

Antisense activity may result from any mechanism involving the hybridization of the antisense compound (e.g., oligonucleotide) with a target nucleic acid, wherein the hybridization ultimately results in a biological effect. In certain embodiments, the amount and/or activity of the target nucleic acid is modulated. In certain embodiments, the amount and/or activity of the target nucleic acid is reduced. In certain embodiments, hybridization of the antisense compound to the target nucleic acid ultimately results in target nucleic acid degradation. In certain embodiments, hybridization of the antisense compound to the target nucleic acid does not result in target nucleic acid degradation. In certain such embodiments, the presence of the antisense compound hybridized with the target nucleic acid (occupancy) results in a modulation of antisense activity. In certain embodiments, antisense compounds having a particular chemical motif or pattern of chemical modifications are particularly suited to exploit one or more mechanisms. In certain embodiments, antisense compounds function through more than one mechanism and/or through mechanisms that have not been elucidated. Accordingly, the antisense compounds described herein are not limited by particular mechanism.

Antisense mechanisms include, without limitation, RNase H mediated antisense; RNAi mechanisms, which utilize the RISC pathway and include, without limitation, siRNA, ssRNA and microRNA mechanisms; and occupancy based mechanisms. Certain antisense compounds may act through more than one such mechanism and/or through additional mechanisms.

RNase H-Mediated Antisense

In certain embodiments, antisense activity results at least in part from degradation of target RNA by RNase H. RNase H is a cellular endonuclease that cleaves the RNA strand of an RNA:DNA duplex. It is known in the art that single-stranded antisense compounds which are "DNA-like" elicit RNase H activity in mammalian cells. Accordingly, antisense compounds comprising at least a portion of DNA or DNA-like nucleosides may activate RNase H, resulting in cleavage of the target nucleic acid. In certain embodiments, antisense compounds that utilize RNase H comprise one or more modified nucleosides. In certain embodiments, such antisense compounds comprise at least one block of 1-8 modified nucleosides. In certain such embodiments, the modified nucleosides do not support RNase H activity. In certain embodiments, such antisense compounds are gapmers, as described herein. In certain such embodiments, the gap of the gapmer comprises DNA nucleosides. In certain such embodiments, the gap of the gapmer comprises DNA-like nucleosides. In certain such embodiments, the gap of the gapmer comprises DNA nucleosides and DNA-like nucleosides.

Certain antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE and 2'-O—CH$_3$, among others), and bicyclic sugar modified nucleosides (such bicyclic sugar modified nucleosides may include those having a constrained ethyl). In certain embodiments, nucleosides in the wings may include several modified sugar moieties, including, for example 2'-MOE and bicyclic sugar moieties such as constrained ethyl or LNA. In certain embodiments, wings may include several modified and unmodified sugar moieties. In certain embodiments, wings may include various combinations of 2'-MOE nucleosides, bicyclic sugar moieties such as constrained ethyl nucleosides or LNA nucleosides, and 2'-deoxynucleosides.

Each distinct region may comprise uniform sugar moieties, variant, or alternating sugar moieties. The wing-gap-wing motif is frequently described as "X—Y—Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X—Y—Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same; in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

In certain embodiments, the antisense compound targeted to an ANGPTL3 nucleic acid has a gapmer motif in which the gap consists of 6, 7, 8, 9, 10, 11, 12, 13, 14, 15, or 16 linked nucleosides.

In certain embodiments, the antisense oligonucleotide has a sugar motif described by Formula A as follows: $(J)_m\text{-}(B)_n\text{-}(J)_p\text{-}(B)_r\text{-}(A)_t\text{-}(D)_g\text{-}(A)_v\text{-}(B)_w\text{-}(J)_x\text{-}(B)_y\text{-}(J)_z$ wherein:

each A is independently a 2'-substituted nucleoside;

each B is independently a bicyclic nucleoside;

each J is independently either a 2'-substituted nucleoside or a 2'-deoxynucleoside;

each D is a 2'-deoxynucleoside;

m is 0-4; n is 0-2; p is 0-2; r is 0-2; t is 0-2; v is 0-2; w is 0-4; x is 0-2; y is 0-2; z is 0-4; g is 6-14;

provided that:

at least one of m, n, and r is other than 0;

at least one of w and y is other than 0;

the sum of m, n, p, r, and t is from 2 to 5; and the sum of v, w, x, y, and z is from 2 to 5.

RNAi Compounds

In certain embodiments, antisense compounds are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). In certain embodiments, antisense compounds comprise modifications that make them particularly suited for such mechanisms.

1. ssRNA Compounds

In certain embodiments, antisense compounds including those particularly suited for use as single-stranded RNAi compounds (ssRNA) comprise a modified 5'-terminal end. In certain such embodiments, the 5'-terminal end comprises a modified phosphate moiety. In certain embodiments, such modified phosphate is stabilized (e.g., resistant to degradation/cleavage compared to unmodified 5'-phosphate). In certain embodiments, such 5'-terminal nucleosides stabilize the 5'-phosphorous moiety. Certain modified 5'-terminal nucleosides may be found in the art, for example in WO/2011/139702.

In certain embodiments, the 5'-nucleoside of an ssRNA compound has Formula IIc:

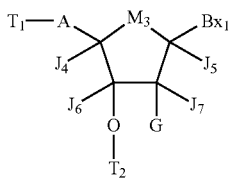

wherein:

$T_1$ is an optionally protected phosphorus moiety;

$T_2$ is an internucleoside linking group linking the compound of Formula IIc to the oligomeric compound;

A has one of the formulas:

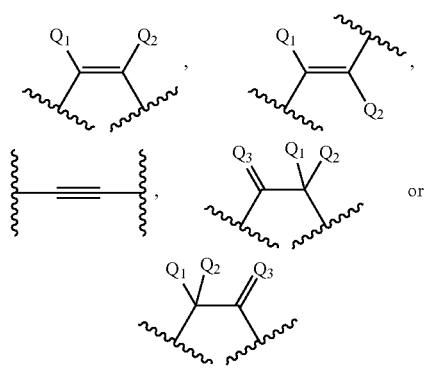

$Q_1$ and $Q_2$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl, substituted $C_2$-$C_6$ alkynyl or $N(R_3)(R_4)$;

$Q_3$ is O, S, $N(R_5)$ or $C(R_6)(R_7)$;

each $R_3$, $R_4$ $R_5$, $R_6$ and $R_7$ is, independently, H, $C_1$-$C_6$ alkyl, substituted $C_1$-$C_6$ alkyl or $C_1$-$C_6$ alkoxy;

$M_3$ is O, S, $NR_{14}$, $C(R_{15})(R_{16})$, $C(R_{15})(R_{16})C(R_{17})(R_{18})$, $C(R_{15})=C(R_{17})$, $OC(R_{15})(R_{16})$ or $OC(R_{15})(Bx_2)$;

$R_{14}$ is H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$R_{15}$, $R_{16}$, $R_{17}$ and $R_{18}$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$Bx_1$ is a heterocyclic base moiety;

or if $Bx_2$ is present then $Bx_2$ is a heterocyclic base moiety and $Bx_1$ is H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl; $J_4$, $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

or $J_4$ forms a bridge with one of $J_5$ or $J_7$ wherein said bridge comprises from 1 to 3 linked biradical groups selected from O, S, $NR_{19}$, $C(R_{20})(R_{21})$, $C(R_{20})=C(R_{21})$, $C[=C(R_{20})(R_{21})]$ and $C(=O)$ and the other two of $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

each $R_{19}$, $R_{20}$ and $R_{21}$ is, independently, H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

G is H, OH, halogen or $O-[C(R_8)(R_9)]_n-[(C=O)_m-X_1]_j-Z$;

each $R_8$ and $R_9$ is, independently, H, halogen, $C_1$-$C_6$ alkyl or substituted $C_1$-$C_6$ alkyl;

$X_1$ is O, S or $N(E_1)$;

Z is H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or $N(E_2)(E_3)$;

$E_1$, $E_2$ and $E_3$ are each, independently, H, $C_1$-$C_6$ alkyl or substituted $C_1$-$C_6$ alkyl;

n is from 1 to about 6;

m is 0 or 1;

j is 0 or 1;

each substituted group comprises one or more optionally protected substituent groups independently selected from halogen, $OJ_1$, $N(J_1)(J_2)$, $=NJ_1$, $SJ_1$, $N_3$, CN, $OC(=X_2)J_1$, $OC(=X_2)N(J_1)(J_2)$ and $C(=X_2)N(J_1)(J_2)$;

$X_2$ is O, S or $NJ_3$;

each $J_1$, $J_2$ and $J_3$ is, independently, H or $C_1$-$C_6$ alkyl;

when j is 1 then Z is other than halogen or $N(E_2)(E_3)$; and wherein said oligomeric compound comprises from 8 to 40 monomeric subunits and is hybridizable to at least a portion of a target nucleic acid.

In certain embodiments, $M_3$ is O, CH=CH, $OCH_2$ or $OC(H)(Bx_2)$. In certain embodiments, $M_3$ is O.

In certain embodiments, $J_4$, $J_5$, $J_6$ and $J_7$ are each H. In certain embodiments, $J_4$ forms a bridge with one of $J_5$ or $J_7$.

In certain embodiments, A has one of the formulas:

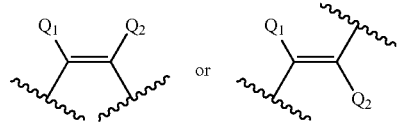

wherein:

$Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In certain embodiments, $Q_1$ and $Q_2$ are each H. In certain embodiments, $Q_1$ and $Q_2$ are each, independently, H or halogen. In certain embodiments, $Q_1$ and $Q_2$ is H and the other of $Q_1$ and $Q_2$ is F, $CH_3$ or $OCH_3$.

In certain embodiments, $T_1$ has the formula:

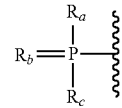

wherein:

$R_a$ and $R_c$ are each, independently, protected hydroxyl, protected thiol, $C_1$-$C_6$ alkyl, substituted $C_1$-$C_6$ alkyl, $C_1$-$C_6$ alkoxy, substituted $C_1$-$C_6$ alkoxy, protected amino or substituted amino; and $R_b$ is O or S. In certain embodiments, $R_b$ is O and $R_a$ and $R_c$ are each, independently, $OCH_3$, $OCH_2CH_3$ or $CH(CH_3)_2$.

In certain embodiments, G is halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2-CH=CH_2$, $O(CH_2)_2-OCH_3$, $O(CH_2)_2-SCH_3$, $O(CH_2)_2-OCF_3$, $O(CH_2)_3-N(R_{10})$ ($R_{11}$), O(CH$_2$)$_2$—ON($R_{10}$)($R_{11}$), O(CH$_2$)$_2$—O(CH$_2$)$_2$—N($R_{10}$)($R_{11}$), OCH$_2$C(=O)—N($R_{10}$)($R_{11}$), OCH$_2$C(=O)—N($R_{12}$)—(CH$_2$)$_2$—N($R_{10}$)($R_{11}$) or O(CH$_2$)$_2$—N($R_{12}$)—C(=N$R_{13}$)N($R_{10}$)($R_{11}$)] wherein $R_{10}$, $R_{11}$, $R_{12}$ and $R_{13}$ are each, independently, H or $C_1$-$C_6$ alkyl. In certain embodiments, G is halogen, OCH$_3$, OCF$_3$, OCH$_2$CH$_3$, OCH$_2$CF$_3$, OCH$_2$—CH=CH$_2$, O(CH$_2$)$_2$—OCH$_3$, O(CH$_2$)$_2$—O(CH$_2$)$_2$—N(CH$_3$)$_2$, OCH$_2$C(=O)—N(H)CH$_3$, OCH$_2$C(=O)—N(H)—(CH$_2$)$_2$—N(CH$_3$)$_2$ or OCH$_2$—N(H)—C(=NH)NH$_2$. In certain embodiments, G is F, OCH$_3$ or O(CH$_2$)$_2$—OCH$_3$. In certain embodiments, G is O(CH$_2$)$_2$—OCH$_3$.

In certain embodiments, the 5'-terminal nucleoside has Formula IIe:

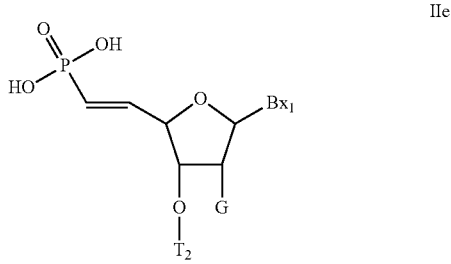

IIe

In certain embodiments, antisense compounds, including those particularly suitable for ssRNA comprise one or more type of modified sugar moieties and/or naturally occurring sugar moieties arranged along an oligonucleotide or region thereof in a defined pattern or sugar modification motif Such motifs may include any of the sugar modifications discussed herein and/or other known sugar modifications.

In certain embodiments, the oligonucleotides comprise or consist of a region having uniform sugar modifications. In certain such embodiments, each nucleoside of the region comprises the same RNA-like sugar modification. In certain embodiments, each nucleoside of the region is a 2'-F nucleoside. In certain embodiments, each nucleoside of the region is a 2'-OMe nucleoside. In certain embodiments, each nucleoside of the region is a 2'-MOE nucleoside. In certain embodiments, each nucleoside of the region is a cEt nucleoside. In certain embodiments, each nucleoside of the region is an LNA nucleoside. In certain embodiments, the uniform region constitutes all or essentially all of the oligonucleotide. In certain embodiments, the region constitutes the entire oligonucleotide except for 1-4 terminal nucleosides.

In certain embodiments, oligonucleotides comprise one or more regions of alternating sugar modifications, wherein the nucleosides alternate between nucleotides having a sugar modification of a first type and nucleotides having a sugar modification of a second type. In certain embodiments, nucleosides of both types are RNA-like nucleosides. In certain embodiments the alternating nucleosides are selected from: 2'-OMe, 2'-F, 2'-MOE, LNA, and cEt. In certain embodiments, the alternating modifications are 2'-F and 2'-OMe. Such regions may be contiguous or may be interrupted by differently modified nucleosides or conjugated nucleosides.

In certain embodiments, the alternating region of alternating modifications each consist of a single nucleoside (i.e., the pattern is (AB)$_x$A$_y$ wherein A is a nucleoside having a sugar modification of a first type and B is a nucleoside having a sugar modification of a second type; x is 1-20 and y is 0 or 1). In certain embodiments, one or more alternating regions in an alternating motif includes more than a single nucleoside of a type. For example, oligonucleotides may include one or more regions of any of the following nucleoside motifs:

AABBAA;
ABBABB;
AABAAB;
ABBABAABB;
ABABAA;
AABABAB;
ABABAA;
ABBAABBABABAA;
BABBAABBABABAA; or
ABABBAABBABABAA;

wherein A is a nucleoside of a first type and B is a nucleoside of a second type. In certain embodiments, A and B are each selected from 2'-F, 2'-OMe, BNA, and MOE.

In certain embodiments, oligonucleotides having such an alternating motif also comprise a modified 5' terminal nucleoside, such as those of formula IIc or IIe.

In certain embodiments, oligonucleotides comprise a region having a 2-2-3 motif Such regions comprises the following motif:

-(A)$_2$-(B)$_x$-(A)$_2$-(C)$_y$-(A)$_3$- wherein: A is a first type of modified nucleoside;
B and C, are nucleosides that are differently modified than A, however, B and C may have the same or different modifications as one another;
x and y are from 1 to 15.

In certain embodiments, A is a 2'-OMe modified nucleoside. In certain embodiments, B and C are both 2'-F modified nucleosides. In certain embodiments, A is a 2'-OMe modified nucleoside and B and C are both 2'-F modified nucleosides.

In certain embodiments, oligonucleosides have the following sugar motif:

5'-(Q)-(AB)$_x$A$_y$-(D)$_z$ wherein:
Q is a nucleoside comprising a stabilized phosphate moiety. In certain embodiments, Q is a nucleoside having Formula IIc or IIe;
A is a first type of modified nucleoside;
B is a second type of modified nucleoside;
D is a modified nucleoside comprising a modification different from the nucleoside adjacent to it. Thus, if y is 0, then D must be differently modified than B and if y is 1, then D must be differently modified than A. In certain embodiments, D differs from both A and B.
X is 5-15;
Y is 0 or 1;
Z is 0-4.

In certain embodiments, oligonucleosides have the following sugar motif:

5'-(Q)-(A)$_x$-(D)$_z$ wherein:
Q is a nucleoside comprising a stabilized phosphate moiety. In certain embodiments, Q is a nucleoside having Formula IIc or IIe;
A is a first type of modified nucleoside;
D is a modified nucleoside comprising a modification different from A.
X is 11-30;
Z is 0-4.

In certain embodiments A, B, C, and D in the above motifs are selected from: 2'-OMe, 2'-F, 2'-MOE, LNA, and cEt. In certain embodiments, D represents terminal nucleosides. In certain embodiments, such terminal nucleosides are not designed to hybridize to the target nucleic acid (though one or more might hybridize by chance). In certain embodiments, the nucleobase of each D nucleoside is adenine, regardless of the identity of the nucleobase at the corresponding position of the target nucleic acid. In certain embodiments the nucleobase of each D nucleoside is thymine. In certain embodiments, antisense compounds, including those particularly suited for use as ssRNA comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least one block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

Oligonucleotides having any of the various sugar motifs described herein, may have any linkage motif. For example, the oligonucleotides, including but not limited to those described above, may have a linkage motif selected from non-limiting the table below:

| 5' most linkage | Central region | 3'-region |
|---|---|---|
| PS | Alternating PO/PS | 6 PS |
| PS | Alternating PO/PS | 7 PS |
| PS | Alternating PO/PS | 8 PS |

2. siRNA Compounds

In certain embodiments, antisense compounds are double-stranded RNAi compounds (siRNA). In such embodiments, one or both strands may comprise any modification motif described above for ssRNA. In certain embodiments, ssRNA compounds may be unmodified RNA. In certain embodiments, siRNA compounds may comprise unmodified RNA nucleosides, but modified internucleoside linkages.

Several embodiments relate to double-stranded compositions wherein each strand comprises a motif defined by the location of one or more modified or unmodified nucleosides. In certain embodiments, compositions are provided comprising a first and a second oligomeric compound that are fully or at least partially hybridized to form a duplex region and further comprising a region that is complementary to and hybridizes to a nucleic acid target. It is suitable that such a composition comprise a first oligomeric compound that is an antisense strand having full or partial complementarity to a nucleic acid target and a second oligomeric compound that is a sense strand having one or more regions of complementarity to and forming at least one duplex region with the first oligomeric compound.

The compositions of several embodiments modulate gene expression by hybridizing to a nucleic acid target resulting in loss of its normal function. In some embodiments, the target nucleic acid is ANGPTL3. In certain embodiment, the degradation of the targeted ANGPTL3 is facilitated by an activated RISC complex that is formed with compositions disclosed herein.

Several embodiments are directed to double-stranded compositions wherein one of the strands is useful in, for example, influencing the preferential loading of the opposite strand into the RISC (or cleavage) complex. The compositions are useful for targeting selected nucleic acid molecules and modulating the expression of one or more genes. In some embodiments, the compositions of the present invention hybridize to a portion of a target RNA resulting in loss of normal function of the target RNA.

Certain embodiments are drawn to double-stranded compositions wherein both the strands comprises a hemimer motif, a fully modified motif, a positionally modified motif or an alternating motif Each strand of the compositions of the present invention can be modified to fulfil a particular role in for example the siRNA pathway. Using a different motif in each strand or the same motif with different chemical modifications in each strand permits targeting the antisense strand for the RISC complex while inhibiting the incorporation of the sense strand. Within this model, each strand can be independently modified such that it is enhanced for its particular role. The antisense strand can be modified at the 5'-end to enhance its role in one region of the RISC while the 3'-end can be modified differentially to enhance its role in a different region of the RISC.

The double-stranded oligonucleotide molecules can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The double-stranded oligonucleotide molecules can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the double-stranded oligonucleotide molecule are complementary to the target nucleic acid or a portion thereof). Alternatively, the double-stranded oligonucleotide is assembled from a single oligonucleotide, where the self-complementary sense and antisense regions of the siRNA are linked by means of a nucleic acid based or non-nucleic acid-based linker(s).

The double-stranded oligonucleotide can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The double-stranded oligonucleotide can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNAi.

In certain embodiments, the double-stranded oligonucleotide comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the double-stranded oligonucleotide comprises nucleotide sequence that is complementary to nucleotide sequence of a target gene. In another embodiment, the double-stranded oligonucleotide interacts with nucleotide sequence of a target gene in a manner that causes inhibition of expression of the target gene.

As used herein, double-stranded oligonucleotides need not be limited to those molecules containing only RNA, but further encompasses chemically modified nucleotides and non-nucleotides. In certain embodiments, the short interfering nucleic acid molecules lack 2'-hydroxy(2'-OH) containing nucleotides. In certain embodiments short interfering nucleic acids optionally do not include any ribonucleotides (e.g., nucleotides having a 2'-OH group). Such double-stranded oligonucleotides that do not require the presence of ribonucleotides within the molecule to support RNAi can however have an attached linker or linkers or other attached or associated groups, moieties, or chains containing one or more nucleotides with 2'-OH groups. Optionally, double-stranded oligonucleotides can comprise ribonucleotides at about 5, 10, 20, 30, 40, or 50% of the nucleotide positions. As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics. For example, double-stranded oligonucleotides can be used to epigenetically silence genes at both the post-transcriptional level and the pre-transcriptional level. In a non-limiting example, epigenetic regulation of gene expression by siRNA molecules of the invention can result from siRNA mediated modification of chromatin structure or methylation pattern to alter gene expression (see, for example, Verdel et al., 2004, Science, 303, 672-676; Pal-Bhadra et al., 2004, Science, 303, 669-672; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

It is contemplated that compounds and compositions of several embodiments provided herein can target ANGPTL3 by a dsRNA-mediated gene silencing or RNAi mechanism, including, e.g., "hairpin" or stem-loop double-stranded RNA effector molecules in which a single RNA strand with self-complementary sequences is capable of assuming a double-stranded conformation, or duplex dsRNA effector molecules comprising two separate strands of RNA. In various embodiments, the dsRNA consists entirely of ribonucleotides or consists of a mixture of ribonucleotides and deoxynucleotides, such as the RNA/DNA hybrids disclosed, for example, by WO 00/63364, filed Apr. 19, 2000, or U.S. Ser. No. 60/130, 377, filed Apr. 21, 1999. The dsRNA or dsRNA effector molecule may be a single molecule with a region of self-complementarity such that nucleotides in one segment of the molecule base pair with nucleotides in another segment of the molecule. In various embodiments, a dsRNA that consists of a single molecule consists entirely of ribonucleotides or includes a region of ribonucleotides that is complementary to a region of deoxyribonucleotides. Alternatively, the dsRNA may include two different strands that have a region of complementarity to each other.

In various embodiments, both strands consist entirely of ribonucleotides, one strand consists entirely of ribonucleotides and one strand consists entirely of deoxyribonucleotides, or one or both strands contain a mixture of ribonucleotides and deoxyribonucleotides. In certain embodiments, the regions of complementarity are at least 70, 80, 90, 95, 98, or 100% complementary to each other and to a target nucleic acid sequence. In certain embodiments, the region of the dsRNA that is present in a double-stranded conformation includes at least 19, 20, 21, 22, 23, 24, 25, 26, 27, 28, 29, 30, 50, 75, 100, 200, 500, 1000, 2000 or 5000 nucleotides or includes all of the nucleotides in a cDNA or other target nucleic acid sequence being represented in the dsRNA. In some embodiments, the dsRNA does not contain any single stranded regions, such as single stranded ends, or the dsRNA is a hairpin. In other embodiments, the dsRNA has one or more single stranded regions or overhangs. In certain embodiments, RNA/DNA hybrids include a DNA strand or region that is an antisense strand or region (e.g, has at least 70, 80, 90, 95, 98, or 100% complementarity to a target nucleic acid) and an RNA strand or region that is a sense strand or region (e.g, has at least 70, 80, 90, 95, 98, or 100% identity to a target nucleic acid), and vice versa.

In various embodiments, the RNA/DNA hybrid is made in vitro using enzymatic or chemical synthetic methods such as those described herein or those described in WO 00/63364, filed Apr. 19, 2000, or U.S. Ser. No. 60/130,377, filed Apr. 21, 1999. In other embodiments, a DNA strand synthesized in vitro is complexed with an RNA strand made in vivo or in vitro before, after, or concurrent with the transformation of the DNA strand into the cell. In yet other embodiments, the dsRNA is a single circular nucleic acid containing a sense and an antisense region, or the dsRNA includes a circular nucleic acid and either a second circular nucleic acid or a linear nucleic acid (see, for example, WO 00/63364, filed Apr. 19, 2000, or U.S. Ser. No. 60/130,377, filed Apr. 21, 1999.) Exemplary circular nucleic acids include lariat structures in which the free 5' phosphoryl group of a nucleotide becomes linked to the 2' hydroxyl group of another nucleotide in a loop back fashion.

In other embodiments, the dsRNA includes one or more modified nucleotides in which the 2' position in the sugar contains a halogen (such as fluorine group) or contains an alkoxy group (such as a methoxy group) which increases the half-life of the dsRNA in vitro or in vivo compared to the corresponding dsRNA in which the corresponding 2' position contains a hydrogen or an hydroxyl group. In yet other embodiments, the dsRNA includes one or more linkages between adjacent nucleotides other than a naturally-occurring phosphodiester linkage. Examples of such linkages include phosphoramide, phosphorothioate, and phosphorodithioate linkages. The dsRNAs may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000, or U.S. Ser. No. 60/130,377, filed Apr. 21, 1999.

In other embodiments, the dsRNA can be any of the at least partially dsRNA molecules disclosed in WO 00/63364, as well as any of the dsRNA molecules described in U.S. Provisional Application 60/399,998; and U.S. Provisional Application 60/419,532, and PCT/US2003/033466, the teaching of which is hereby incorporated by reference. Any of the dsRNAs may be expressed in vitro or in vivo using the methods described herein or standard methods, such as those described in WO 00/63364.

Occupancy

In certain embodiments, antisense compounds are not expected to result in cleavage or the target nucleic acid via RNase H or to result in cleavage or sequestration through the RISC pathway. In certain such embodiments, antisense activity may result from occupancy, wherein the presence of the hybridized antisense compound disrupts the activity of the target nucleic acid. In certain such embodiments, the antisense compound may be uniformly modified or may comprise a mix of modifications and/or modified and unmodified nucleosides.

Target Nucleic Acids, Target Regions and Nucleotide Sequences

Nucleotide sequences that encode ANGPTL3 include, without limitation, the following: the human sequence as set forth in GenBank Accession No. NM_014495.2 (incorporated herein as SEQ ID NO: 1) or GenBank Accession No. NT_032977.9 nucleotides 33032001 to 33046000 (incorporated herein as SEQ ID NO: 2). It is understood that the sequence set forth in each SEQ ID NO in the Examples contained herein is independent of any modification to a sugar moiety, an internucleoside linkage, or a nucleobase. As such, antisense compounds defined by a SEQ ID NO can comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region can encompass a 3' UTR, a 5' UTR, an exon, an intron, an exon/intron junction, a coding region, a translation initiation region, translation termination region, or other defined nucleic acid region. The structurally defined regions for ANGPTL3 can be obtained by accession number from sequence databases such as NCBI and such information is incorporated herein by reference. In certain embodiments, a target region can encompass the sequence from a 5' target site of one target segment within the target region to a 3' target site of another target segment within the target region.

In certain embodiments, a "target segment" is a smaller, sub-portion of a target region within a nucleic acid. For example, a target segment can be the sequence of nucleotides of a target nucleic acid to which one or more antisense compound is targeted. "5' target site" or "5' start site" refers to the 5'-most nucleotide of a target segment. "3' target site" or "3' stop site" refers to the 3'-most nucleotide of a target segment.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region can contain one or more target segments. Multiple target segments within a target region can be overlapping. Alternatively, they can be non-overlapping. In certain embodiments, target segments within a target region are separated by no more than about 300 nucleotides. In certain embodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments can be found within a 5' UTR, a coding region, a 3' UTR, an intron, an exon, or an exon/intron junction. Target segments containing a start codon or a stop codon are also suitable target segments. A suitable target segment can specifically exclude a certain structurally defined region such as the start codon or stop codon.

The determination of suitable target segments can include a comparison of the sequence of a target nucleic acid to other sequences throughout the genome. For example, the BLAST algorithm can be used to identify regions of similarity amongst different nucleic acids. This comparison can prevent the selection of antisense compound sequences that can hybridize in a non-specific manner to sequences other than a selected target nucleic acid (i.e., non-target or off-target sequences).

There can be variation in activity (e.g., as defined by percent reduction of target nucleic acid levels) of the antisense compounds within an active target region. In certain embodiments, reductions in ANGPTL3 mRNA levels are indicative of inhibition of ANGPTL3 protein expression. Reductions in levels of an ANGPTL3 protein are also indicative of inhibition of target mRNA expression. Further, phenotypic changes, such as a reduction of the level of cholesterol, LDL, triglyceride, or glucose, can be indicative of inhibition of ANGPTL3 mRNA and/or protein expression.

Hybridization

In some embodiments, hybridization occurs between an antisense compound disclosed herein and an ANGPTL3 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art (Sambrook and Russell, Molecular Cloning: A Laboratory Manual, 3$^{rd}$ Ed., 2001). In certain embodiments, the antisense compounds provided herein are specifically hybridizable with an ANGPTL3 nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as an ANGPTL3 nucleic acid).

An antisense compound can hybridize over one or more segments of an ANGPTL3 nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 75%, 80%, 85%, 86%, 87%, 88%, 89%, 90%, 91%, 92%, 93%, 94%, 95%, 96%, 97%, 98%, 99%, or 100% complementary to an ANGPTL3 nucleic acid, a target region, target segment, or specified portion thereof. In certain embodiments, the antisense compounds provided herein, or a specified portion thereof, are, or are at least, 70%, 75%, 80%, 85%, 86%, 87%, 88%, 89%, 90%, 91%, 92%, 93%, 94%, 95%, 96%, 97%, 98%, 99%, or 100% complementary to the sequence of one or more of SEQ ID NOs: 1-2. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases can be clustered or interspersed with complementary nucleobases and need not be contiguous to each other or to complementary nucleobases. As such, an antisense compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., J. Mol. Biol., 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound can be fully complementary to an ANGPTL3 nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound can be fully complementary to the target sequence, depending on whether the remaining 10 nucleobases of the antisense compound are also complementary to the target sequence.

The location of a non-complementary nucleobase can be at the 5' end or 3' end of the antisense compound. Alternatively, the non-complementary nucleobase or nucleobases can be at an internal position of the antisense compound. When two or more non-complementary nucleobases are present, they can be either contiguous (i.e. linked) or non-contiguous. In one embodiment, a non-complementary nucleobase is located in the wing segment of a gapmer antisense oligonucleotide.

In certain embodiments, antisense compounds that are, or are up to 10, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as an ANGPTL3 nucleic acid, or specified portion thereof.

In certain embodiments, antisense compounds that are, or are up to 10, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as an ANGPTL3 nucleic acid, or specified portion thereof.

The antisense compounds provided herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 10 nucleobase portion of a target segment. In certain embodiments, the antisense compounds are complementary to at least a 15 nucleobase portion of a target segment. Also contemplated are antisense compounds that are complementary to at least an 8, 9, 10, 11, 12, 13, 14, 15, 16, 17, 18, 19, 20, or more nucleobase portion of a target segment, or a range defined by any two of these values.

Identity

The antisense compounds provided herein can also have a defined percent identity to a particular nucleotide sequence, SEQ ID NO, or the sequence of a compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases can be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

Modifications A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides can also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to an ANGPTL3 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides of the present invention comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosphonate linkages. In certain embodiments, oligonucleotides having a gapmer nucleoside motif comprise a linkage motif comprising all phosphorothioate linkages except for one or two methylphosphonate linkages. In certain embodiments, one methylphosphonate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Modified Sugar Moieties

Antisense compounds of the invention can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or $C(R_1)(R_2)$ (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-OCH$_3$, 2'-OCH$_2$CH$_3$, 2'-OCH$_2$CH$_2$F and 2'-O(CH$_2$)$_2$OCH$_3$ substituent groups. The substituent at the 2' position can also be selected from allyl, amino, azido, thio, O-allyl, O—C$_1$-C$_{10}$ alkyl, OCF$_3$, OCH$_2$F, O(CH$_2$)$_2$SCH$_3$, O(CH$_2$)$_2$—O—N(R$_m$)(R$_n$), O—CH$_2$—C(=O)—N(R$_m$)(R$_n$), and O—CH$_2$—C(=O)—N(R$_1$)—(CH$_2$)$_2$—N(R$_m$)(R$_n$), where each R$_l$, R$_m$ and R$_n$ is, independently, H or substituted or unsubstituted C$_1$-C$_{10}$ alkyl.

As used herein, "bicyclic nucleosides" refer to modified nucleosides comprising a bicyclic sugar moiety. Examples of bicyclic nucleic acids (BNAs) include without limitation nucleosides comprising a bridge between the 4' and the 2' ribosyl ring atoms. In certain embodiments, antisense compounds provided herein include one or more BNA nucleosides wherein the bridge comprises one of the formulas: 4'-(CH$_2$)—O-2' (LNA); 4'-(CH$_2$)—S-2; 4'-(CH$_2$)$_2$—O-2' (ENA); 4'-CH(CH$_3$)—O-2' and 4'-CH(CH$_2$OCH$_3$)—O-2' (and analogs thereof see U.S. Pat. No. 7,399,845, issued on Jul. 15, 2008); 4'-C(CH$_3$)(CH$_3$)—O-2' (and analogs thereof see PCT/US2008/068922 published as WO 2009/006478, published Jan. 8, 2009); 4'-CH$_2$—N(OCH$_3$)-2' (and analogs thereof see PCT/US2008/064591 published as WO/2008/150729, published Dec. 11, 2008); 4'-CH$_2$—O—N(CH$_3$)-2' (see published U.S. Patent Application US2004-0171570, published Sep. 2, 2004); 4'-CH$_2$—N(R)—O-2', wherein R is H, C$_1$-C$_{12}$ alkyl, or a protecting group (see U.S. Pat. No. 7,427,672, issued on Sep. 23, 2008); 4'-CH$_2$—C(H)(CH$_3$)-2' (see Zhou et al., *J. Org. Chem.*, 2009, 74, 118-134); and 4'-CH$_2$—C(=CH$_2$)-2' (and analogs thereof see PCT/US2008/066154 published as WO 2008/154401, published on Dec. 8, 2008).

Further bicyclic nucleosides have been reported in published literature (see for example: Srivastava et al., *J. Am. Chem. Soc.*, 2007, 129(26) 8362-8379; Frieden et al., *Nucleic Acids Research*, 2003, 21, 6365-6372; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; Wahlestedt et al., *Proc. Natl. Acad. Sci. U.S.A*, 2000, 97, 5633-5638; Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; U.S. Pat. Nos. 7,741,457; 7,399,845; 7,053,207; 7,034,133; 6,794,499; 6,770,748; 6,670,461; 6,525,191; 6,268,490; U.S. Patent Publication Nos.: US2008-0039618; US2007-0287831; US2004-0171570; U.S. Patent Applications, Ser. Nos. 61/097,787; 61/026,995; and International applications: WO 2009/006478; WO 2008/154401; WO 2008/150729; WO 2009/100320; WO 2011/017521; WO 2009/067647; WO 2010/036698; WO 2007/134181; WO 2005/021570; WO 2004/106356; WO 99/14226. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

As used herein, "monocylic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

In certain embodiments, bicyclic sugar moieties of BNA nucleosides include, but are not limited to, compounds having at least one bridge between the 4' and the 2' carbon atoms of the pentofuranosyl sugar moiety including without limitation, bridges comprising 1 or from 1 to 4 linked groups independently selected from —[C(R$_a$)(R$_b$)]$_n$—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—; wherein: x is 0, 1, or 2; n is 1, 2, 3, or 4; each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxy (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In certain embodiments, the bridge of a bicyclic sugar moiety is, —[C(R$_a$)(R$_b$)]$_n$—, —[C(R$_a$)(R$_b$)]$_n$—O—, —C(R$_a$R$_b$)—N(R)—O— or —C(R$_a$R$_b$)—O—N(R)—. In certain embodiments, the bridge is 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R)-2' and 4'-CH$_2$—N(R)—O-2'- wherein each R is, independently, H, a protecting group or C$_1$-C$_{12}$ alkyl.

In certain embodiments, bicyclic nucleosides are further defined by isomeric configuration. For example, a nucleoside comprising a 4'-(CH$_2$)—O-2' bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include those having a 4' to 2' bridge wherein such bridges include without limitation, α-L-4'-(CH$_2$)—O-2', β-D-4'-CH$_2$—O-2', 4'-(CH$_2$)$_2$—O-2', 4'-CH$_2$—O—N(R)-2', 4'-CH$_2$—N(R)—O-2', 4'-CH(CH$_3$)—O-2', 4'-CH$_2$—S-2', 4'-CH$_2$—N(R)-2', 4'-CH$_2$—CH(CH$_3$)-2', and 4'-(CH$_2$)$_3$-2', wherein R is H, a protecting group or C$_1$-C$_{12}$ alkyl.

In certain embodiment, bicyclic nucleosides have the formula:

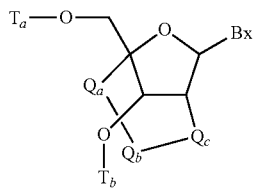

wherein:

Bx is a heterocyclic base moiety;

-Q$_a$-Q$_b$-Q$_c$- is —CH$_2$—N(R$_c$)—CH$_2$—, —C(=O)—N(R$_c$)—CH$_2$—, —CH$_2$—O—N(R$_c$)—, —CH$_2$—N(R$_c$)—O— or —N(R$_c$)—O—CH$_2$;

R$_c$ is C$_1$-C$_{12}$ alkyl or an amino protecting group; and

T$_a$ and T$_b$ are each, independently H, a hydroxyl protecting group, a conjugate group, a reactive phosphorus group, a phosphorus moiety or a covalent attachment to a support medium.

In certain embodiments, bicyclic nucleosides have the formula:

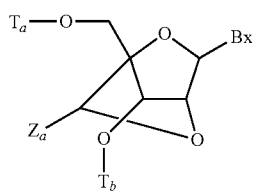

wherein:

Bx is a heterocyclic base moiety;

T$_a$ and T$_b$ are each, independently H, a hydroxyl protecting group, a conjugate group, a reactive phosphorus group, a phosphorus moiety or a covalent attachment to a support medium;

Z$_a$ is C$_1$-C$_6$ alkyl, C$_2$-C$_6$ alkenyl, C$_2$-C$_6$ alkynyl, substituted C$_1$-C$_6$ alkyl, substituted C$_2$-C$_6$ alkenyl, substituted C$_2$-C$_6$ alkynyl, acyl, substituted acyl, substituted amide, thiol or substituted thiol.

In one embodiment, each of the substituted groups, is, independently, mono or poly substituted with substituent groups independently selected from halogen, oxo, hydroxyl, OJ$_c$, NJ$_c$J$_d$, SJ$_c$, N$_3$, OC(=X)J$_c$, and NJ$_e$C(=X)NJ$_c$J$_d$, wherein each J$_c$, J$_d$ and J$_e$ is, independently, H, C$_1$-C$_6$ alkyl, or substituted C$_1$-C$_6$ alkyl and X is O or NJ$_c$.

In certain embodiments, bicyclic nucleosides have the formula:

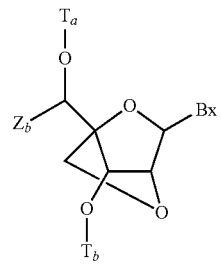

wherein:

Bx is a heterocyclic base moiety;

T$_a$ and T$_b$ are each, independently H, a hydroxyl protecting group, a conjugate group, a reactive phosphorus group, a phosphorus moiety or a covalent attachment to a support medium;

Z$_b$ is C$_1$-C$_6$ alkyl, C$_2$-C$_6$ alkenyl, C$_2$-C$_6$ alkynyl, substituted C$_1$-C$_6$ alkyl, substituted C$_2$-C$_6$ alkenyl, substituted C$_2$-C$_6$ alkynyl or substituted acyl (C(=O)—).

In certain embodiments, bicyclic nucleosides have the formula:

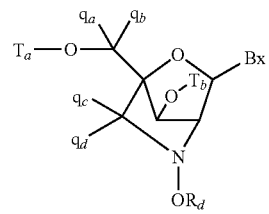

wherein:

Bx is a heterocyclic base moiety;

T$_a$ and T$_b$ are each, independently H, a hydroxyl protecting group, a conjugate group, a reactive phosphorus group, a phosphorus moiety or a covalent attachment to a support medium;

R$_d$ is C$_1$-C$_6$ alkyl, substituted C$_1$-C$_6$ alkyl, C$_2$-C$_6$ alkenyl, substituted C$_2$-C$_6$ alkenyl, C$_2$-C$_6$ alkynyl or substituted C$_2$-C$_6$ alkynyl;

each q$_a$, q$_b$, q$_c$ and q$_d$ is, independently, H, halogen, C$_1$-C$_6$ alkyl, substituted C$_1$-C$_6$ alkyl, C$_2$-C$_6$ alkenyl, substituted C$_2$-C$_6$ alkenyl, C$_2$-C$_6$ alkynyl or substituted C$_2$-C$_6$ alkynyl, C$_1$-C$_6$ alkoxyl, substituted C$_1$-C$_6$ alkoxyl, acyl, substituted acyl, C$_1$-C$_6$ aminoalkyl or substituted C$_1$-C$_6$ aminoalkyl;

In certain embodiments, bicyclic nucleosides have the formula:

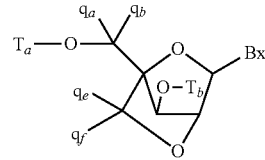

wherein:

Bx is a heterocyclic base moiety;

T$_a$ and T$_b$ are each, independently H, a hydroxyl protecting group, a conjugate group, a reactive phosphorus group, a phosphorus moiety or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$;

or $q_e$ and $q_f$ together are =C($q_g$)($q_h$);

$q_g$ and $q_h$ are each, independently, H, halogen, $C_1$-$C_{12}$ alkyl or substituted $C_1$-$C_{12}$ alkyl.

The synthesis and preparation of adenine, cytosine, guanine, 5-methyl-cytosine, thymine and uracil bicyclic nucleosides having a 4'-$CH_2$—O-2' bridge, along with their oligomerization, and nucleic acid recognition properties have been described (Koshkin et al., *Tetrahedron*, 1998, 54, 3607-3630). The synthesis of bicyclic nucleosides has also been described in WO 98/39352 and WO 99/14226.

Analogs of various bicyclic nucleosides that have 4' to 2' bridging groups such as 4'-$CH_2$—O-2' and 4'-$CH_2$—S-2', have also been prepared (Kumar et al., *Bioorg. Med. Chem. Lett.*, 1998, 8, 2219-2222). Preparation of oligodeoxyribonucleotide duplexes comprising bicyclic nucleosides for use as substrates for nucleic acid polymerases has also been described (Wengel et al., WO 99/14226). Furthermore, synthesis of 2'-amino-BNA, a novel conformationally restricted high-affinity oligonucleotide analog has been described in the art (Singh et al., *J. Org. Chem.*, 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides have the formula:

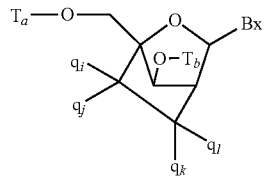

wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-$(CH_2)_3$-2' bridge and the alkenyl analog bridge 4'-CH=CH—$CH_2$-2' have been described (Frier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.* 2007, 129(26), 8362-8379).

In certain embodiments, bicyclic nucleosides include, but are not limited to, (A) α-L-methyleneoxy (4'-$CH_2$—O-2') BNA, (B) β-D-methyleneoxy (4'-$CH_2$—O-2') BNA, (C) ethyleneoxy (4'-$(CH_2)_2$—O-2') BNA, (D) aminooxy (4'-$CH_2$—O—N(R)-2') BNA, (E) oxyamino (4'-$CH_2$—N(R)—O-2') BNA, (F) methyl(methyleneoxy) (4'-CH($CH_3$)—O-2') BNA (also referred to as constrained ethyl or cEt), (G) methylenethio (4'-$CH_2$—S-2') BNA, (H) methylene-amino (4'-$CH_2$—N(R)-2') BNA, (I) methyl carbocyclic (4'-$CH_2$—CH($CH_3$)-2') BNA, (J) propylene carbocyclic (4'-$(CH_2)_3$-2') BNA, and (K) vinyl BNA as depicted below.

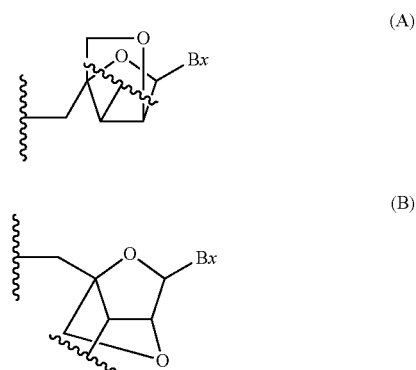

(A)

(B)

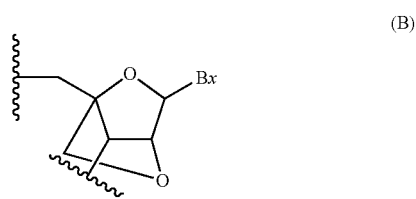

(C)

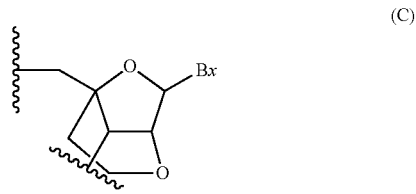

(D)

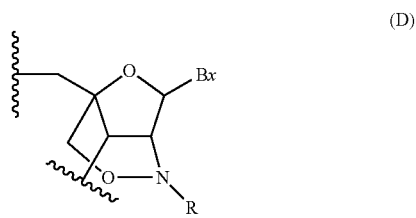

(E)

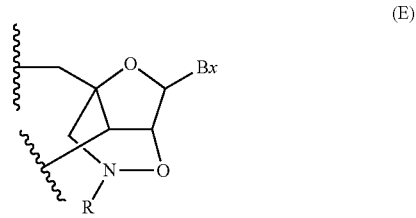

(F)

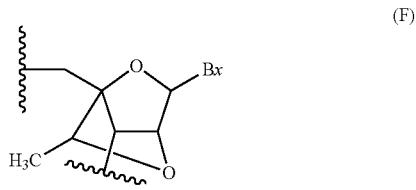

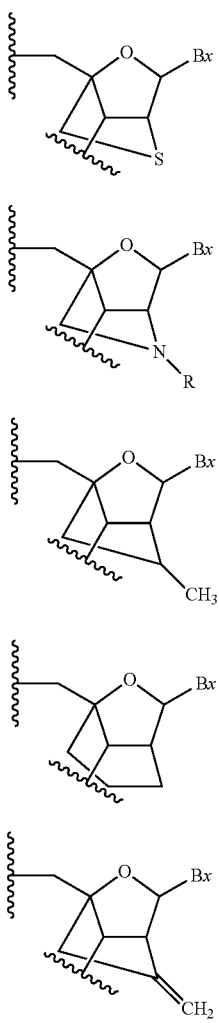

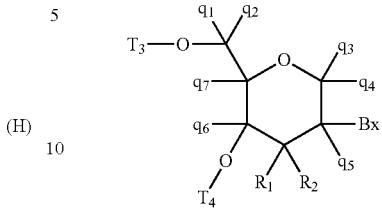

wherein Bx is the base moiety and R is, independently, H, a protecting group, $C_1$-$C_6$ alkyl or $C_1$-$C_6$ alkoxy.

As used herein, the term "modified tetrahydropyran nucleoside" or "modified THP nucleoside" means a nucleoside having a six-membered tetrahydropyran "sugar" substituted for the pentofuranosyl residue in normal nucleosides and can be referred to as a sugar surrogate. Modified THP nucleosides include, but are not limited to, what is referred to in the art as hexitol nucleic acid (HNA), anitol nucleic acid (ANA), manitol nucleic acid (MNA) (see Leumann, *Bioorg. Med. Chem.,* 2002, 10, 841-854) or fluoro HNA (F-HNA) having a tetrahydropyranyl ring system as illustrated below.

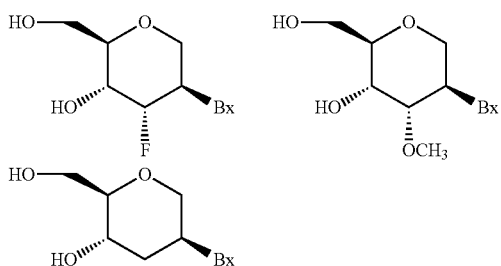

In certain embodiment, sugar surrogates are selected having the formula:

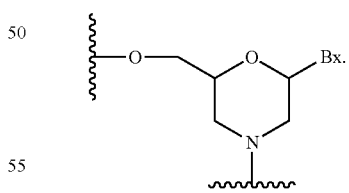

wherein:
Bx is a heterocyclic base moiety;
$T_3$ and $T_4$ are each, independently, an internucleoside linking group linking the tetrahydropyran nucleoside analog to the oligomeric compound or one of $T_3$ and $T_4$ is an internucleoside linking group linking the tetrahydropyran nucleoside analog to an oligomeric compound or oligonucleotide and the other of $T_3$ and $T_4$ is H, a hydroxyl protecting group, a linked conjugate group or a 5' or 3'-terminal group;

$q_1, q_2, q_3, q_4, q_5, q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and one of $R_1$ and $R_2$ is hydrogen and the other is selected from halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$ and CN, wherein X is O, S or $NJ_1$ and each $J_1$, $J_2$ and $J_3$ is, independently, H or $C_1$-$C_6$ alkyl.

In certain embodiments, $q_1, q_2, q_3, q_4, q_5, q_6$ and $q_7$ are each H. In certain embodiments, at least one of $q_1, q_2, q_3, q_4, q_5, q_6$ and $q_7$ is other than H. In certain embodiments, at least one of $q_1, q_2, q_3, q_4, q_5, q_6$ and $q_7$ is methyl. In certain embodiments, THP nucleosides are provided wherein one of $R_1$ and $R_2$ is F. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following formula:

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5',2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., *J. Am. Chem. Soc.*, 2008, 130(6), 1979-1984; Horváth et al., *Tetrahedron Letters*, 2007, 48, 3621-3623; Nauwelaerts et al., *J. Am. Chem. Soc.*, 2007, 129(30), 9340-9348; Gu et al., *Nucleosides, Nucleotides & Nucleic Acids*, 2005, 24(5-7), 993-998; Nauwelaerts et al., *Nucleic Acids Research*, 2005, 33(8), 2452-2463; Robeyns et al., *Acta Crystallographica*, Section F: *Structural Biology and Crystallization Communications*, 2005, F61(6), 585-586; Gu et al., *Tetrahedron*, 2004, 60(9), 2111-2123; Gu et al., *Oligonucleotides*, 2003, 13(6), 479-489; Wang et al., *J Org. Chem.*, 2003, 68, 4499-4505; Verbeure et al., *Nucleic Acids Research*, 2001, 29(24), 4941-4947; Wang et al., *J. Org. Chem.*, 2001, 66, 8478-82; Wang et al., *Nucleosides, Nucleotides & Nucleic Acids*, 2001, 20(4-7), 785-788; Wang et al., *J. Am. Chem.*, 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

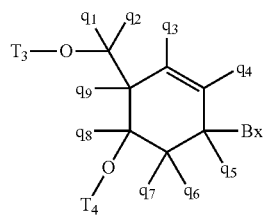

X wherein independently for each of said at least one cyclohexenyl nucleoside analog of Formula X:

Bx is a heterocyclic base moiety;

$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and $q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

Many other monocyclic, bicyclic and tricyclic ring systems are known in the art and are suitable as sugar surrogates that can be used to modify nucleosides for incorporation into oligomeric compounds as provided herein (see for example review article: Leumann, Christian J. *Bioorg. & Med. Chem.*, 2002, 10, 841-854). Such ring systems can undergo various additional substitutions to further enhance their activity.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: $O[(CH_2)_nO]_mCH_3$, $O(CH_2)_nNH_2$, $O(CH_2)_nCH_3$, $O(CH_2)_nF$, $O(CH_2)_nONH_2$, $OCH_2C(=O)N(H)CH_3$, and $O(CH_2)_nON[(CH_2)_nCH_3]_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2' substituents, such as allyl, amino, azido, thio, O-allyl, O—$C_1$-$C_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), or O—CH$_2$—C(=O)—N(R$_m$)(R$_n$), where each R$_m$ and R$_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-OCH$_3$", "2'-O-methyl" or "2'-methoxy" each refers to a nucleoside comprising a sugar comprising an —OCH$_3$ group at the 2' position of the sugar ring.

As used herein, "MOE" or "2'-MOE" or "2'-OCH$_2$CH$_2$OCH$_3$" or "2'-O-methoxyethyl" each refers to a nucleoside comprising a sugar comprising a —OCH$_2$CH$_2$OCH$_3$ group at the 2' position of the sugar ring.

Methods for the preparations of modified sugars are well known to those skilled in the art. Some representative U.S. patents that teach the preparation of such modified sugars include without limitation, U.S. Pat. Nos. 4,981,957; 5,118,800; 5,319,080; 5,359,044; 5,393,878; 5,446,137; 5,466,786;

5,514,785; 5,519,134; 5,567,811; 5,576,427; 5,591,722; 5,597,909; 5,610,300; 5,627,053; 5,639,873; 5,646,265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-CH(CH$_3$)—O-2') bridging group. In certain embodiments, the (4'-CH(CH$_3$)—O-2') modified nucleosides are arranged throughout the wings of a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., Antisense Research and Applications, CRC Press, Boca Raton, 1993, pp. 276-278).

Additional modified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties can also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and O-6 substituted purines, including 2 aminopropyladenine, 5-propynyluracil and 5-propynylcytosine.

In certain embodiments, antisense compounds targeted to an ANGPTL3 nucleic acid comprise one or more modified nucleobases. In certain embodiments, shortened or gap-widened antisense oligonucleotides targeted to an ANGPTL3 nucleic acid comprise one or more modified nucleobases. In certain embodiments, the modified nucleobase is 5-methylcytosine. In certain embodiments, each cytosine is a 5-methylcytosine.

Compositions and Methods for Formulating Pharmaceutical Compositions

Antisense oligonucleotides can be admixed with pharmaceutically acceptable active or inert substance for the preparation of pharmaceutical compositions or formulations. Compositions and methods for the formulation of pharmaceutical compositions are dependent upon a number of criteria, including, but not limited to, route of administration, extent of disease, or dose to be administered.

Antisense compound targeted to an ANGPTL3 nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, in one embodiment, employed in the methods described herein is a pharmaceutical composition comprising an antisense compound targeted to an ANGPTL3 nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

Conjugated Antisense Compounds

Antisense compounds can be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acids from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

In certain embodiments, the present disclosure provides conjugated antisense compounds represented by the formula:

A-B-C-D-(-E-F)$_q$ wherein

A is the antisense oligonucleotide;
B is the cleavable moiety
C is the conjugate linker
D is the branching group
each E is a tether;
each F is a ligand; and
q is an integer between 1 and 5.

In certain embodiments, conjugated antisense compounds are provided having the structure:

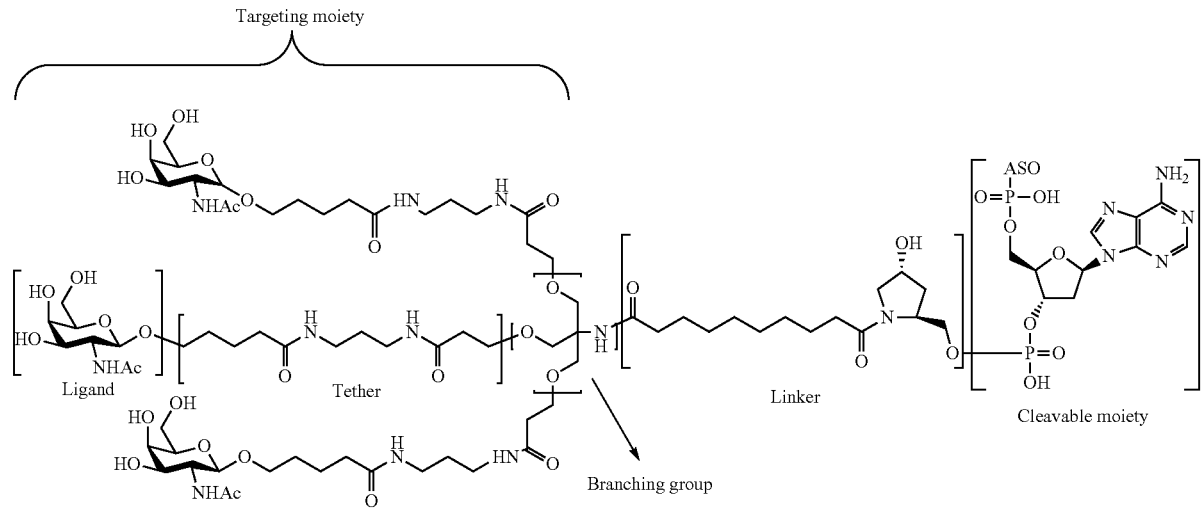

In certain embodiments, conjugated antisense compounds are provided having the structure:

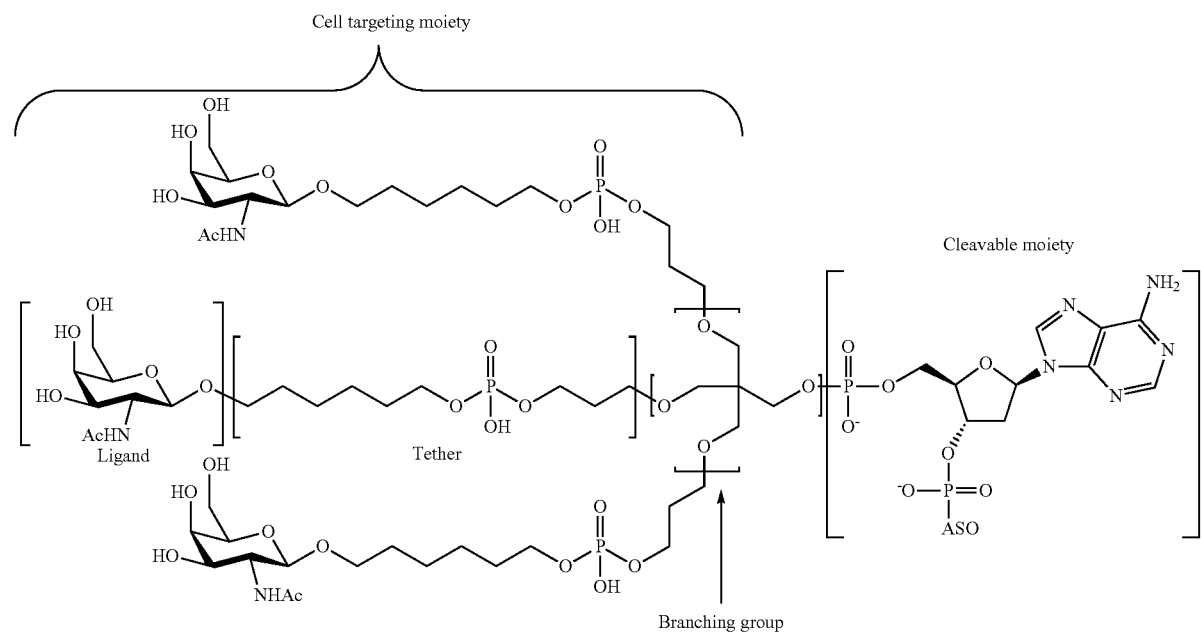

In certain embodiments, conjugated antisense compounds are provided having the structure:
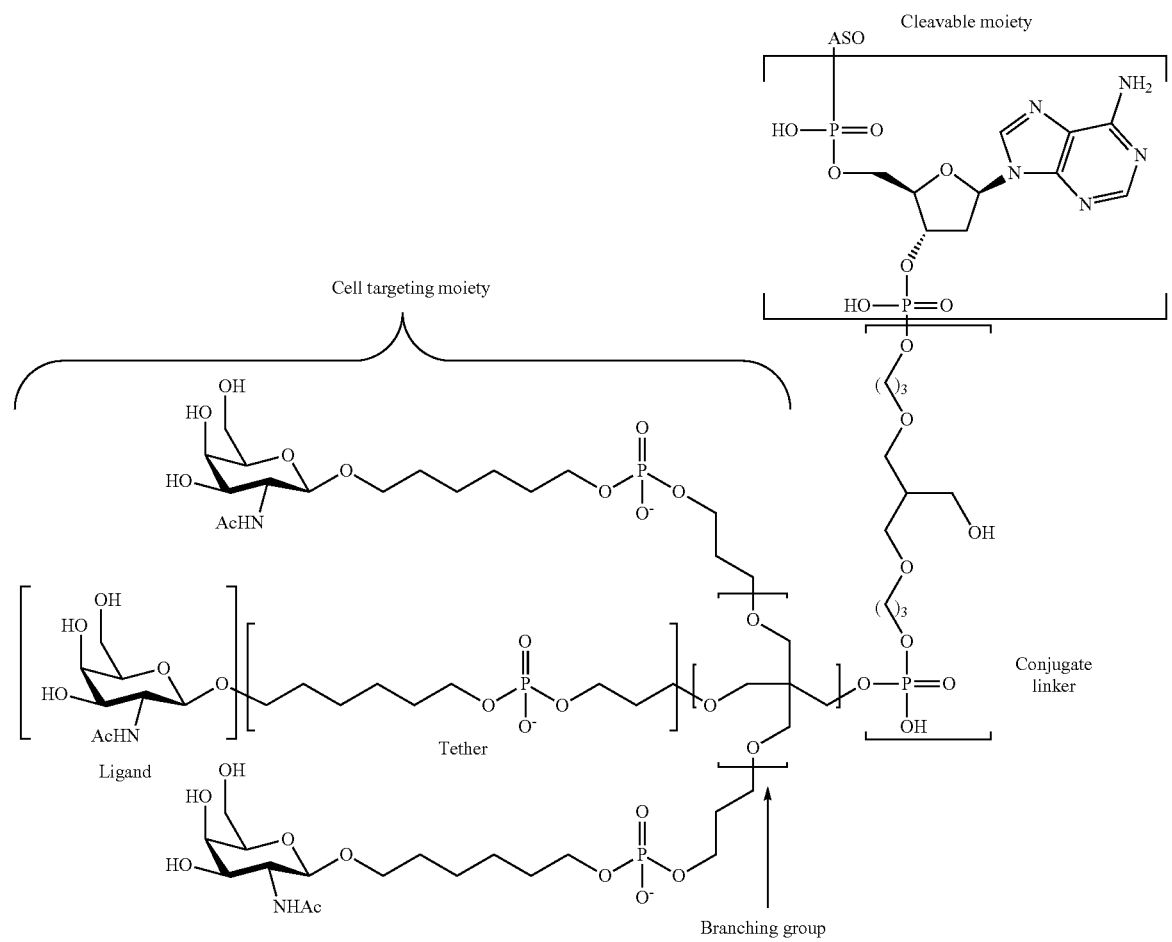
The present disclosure provides the following non-limiting numbered embodiments:
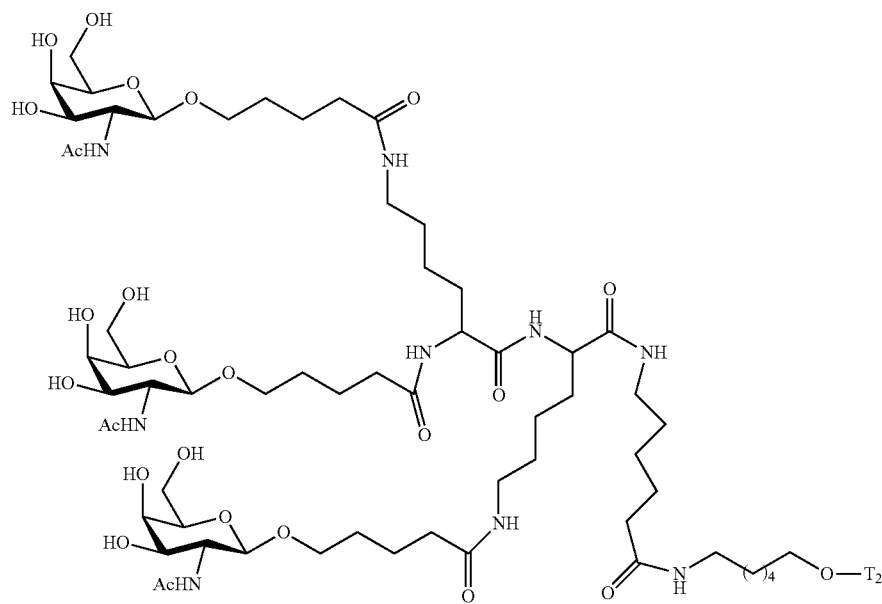

wherein:

T₂ is a nucleoside, a nucleotide, a monomeric subunit, or an oligomeric compound.

In embodiments having more than one of a particular variable (e.g., more than one "m" or "n"), unless otherwise indicated, each such particular variable is selected independently. Thus, for a structure having more than one n, each n is selected independently, so they may or may not be the same as one another.

i. Certain Cleavable Moieties

In certain embodiments, a cleavable moiety is a cleavable bond. In certain embodiments, a cleavable moiety comprises a cleavable bond. In certain embodiments, the conjugate group comprises a cleavable moiety. In certain such embodiments, the cleavable moiety attaches to the antisense oligonucleotide. In certain such embodiments, the cleavable moiety attaches directly to the cell-targeting moiety. In certain such embodiments, the cleavable moiety attaches to the conjugate linker. In certain embodiments, the cleavable moiety comprises a phosphate or phosphodiester. In certain embodiments, the cleavable moiety is a cleavable nucleoside or nucleoside analog. In certain embodiments, the nucleoside or nucleoside analog comprises an optionally protected heterocyclic base selected from a purine, substituted purine, pyrimidine or substituted pyrimidine. In certain embodiments, the cleavable moiety is a nucleoside comprising an optionally protected heterocyclic base selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. In certain embodiments, the cleavable moiety is 2'-deoxy nucleoside that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester linkage.

In certain embodiments, the cleavable moiety is attached to the 3' position of the antisense oligonucleotide. In certain embodiments, the cleavable moiety is attached to the 5' position of the antisense oligonucleotide. In certain embodiments, the cleavable moiety is attached to a 2' position of the antisense oligonucleotide. In certain embodiments, the cleavable moiety is attached to the antisense oligonucleotide by a phosphodiester linkage. In certain embodiments, the cleavable moiety is attached to the linker by either a phosphodiester or a phosphorothioate linkage. In certain embodiments, the cleavable moiety is attached to the linker by a phosphodiester linkage. In certain embodiments, the conjugate group does not include a cleavable moiety.

In certain embodiments, the cleavable moiety is cleaved after the complex has been administered to an animal only after being internalized by a targeted cell. Inside the cell the cleavable moiety is cleaved thereby releasing the active antisense oligonucleotide. While not wanting to be bound by theory it is believed that the cleavable moiety is cleaved by one or more nucleases within the cell. In certain embodiments, the one or more nucleases cleave the phosphodiester linkage between the cleavable moiety and the linker. In certain embodiments, the cleavable moiety has a structure selected from among the following:

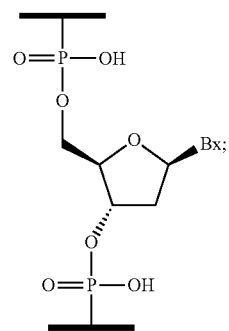

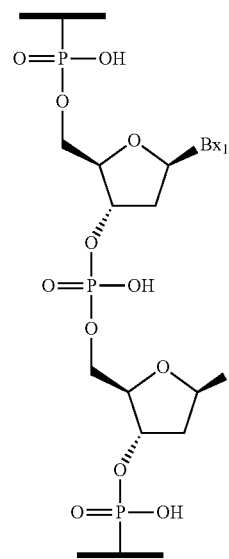

and

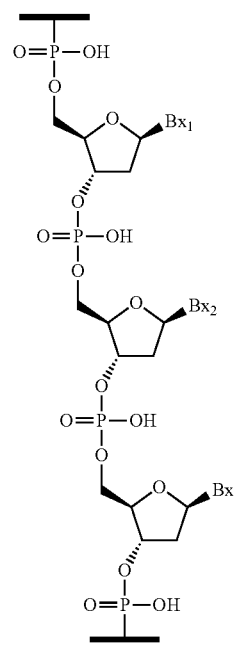

wherein each of Bx, Bx₁, Bx₂, and Bx₃ is independently a heterocyclic base moiety. In certain embodiments, the cleavable moiety has a structure selected from among the following:

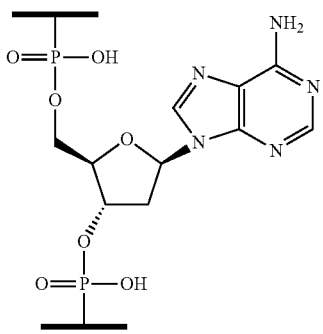

i. Certain Linkers

In certain embodiments, the conjugate groups comprise a linker. In certain such embodiments, the linker is covalently bound to the cleavable moiety. In certain such embodiments, the linker is covalently bound to the antisense oligonucleotide. In certain embodiments, the linker is covalently bound to a cell-targeting moiety. In certain embodiments, the linker further comprises a covalent attachment to a solid support. In certain embodiments, the linker further comprises a covalent attachment to a protein binding moiety. In certain embodiments, the linker further comprises a covalent attachment to a solid support and further comprises a covalent attachment to a protein binding moiety. In certain embodiments, the linker includes multiple positions for attachment of tethered ligands. In certain embodiments, the linker includes multiple positions for attachment of tethered ligands and is not attached to a branching group. In certain embodiments, the linker further comprises one or more cleavable bond. In certain embodiments, the conjugate group does not include a linker.

In certain embodiments, the linker includes at least a linear group comprising groups selected from alkyl, amide, disulfide, polyethylene glycol, ether, thioether (—S—) and hydroxylamino (—O—N(H)—) groups. In certain embodiments, the linear group comprises groups selected from alkyl, amide and ether groups. In certain embodiments, the linear group comprises groups selected from alkyl and ether groups. In certain embodiments, the linear group comprises at least one phosphorus linking group. In certain embodiments, the linear group comprises at least one phosphodiester group. In certain embodiments, the linear group includes at least one neutral linking group. In certain embodiments, the linear group is covalently attached to the cell-targeting moiety and the cleavable moiety. In certain embodiments, the linear group is covalently attached to the cell-targeting moiety and the antisense oligonucleotide. In certain embodiments, the linear group is covalently attached to the cell-targeting moiety, the cleavable moiety and a solid support. In certain embodiments, the linear group is covalently attached to the cell-targeting moiety, the cleavable moiety, a solid support and a protein binding moiety. In certain embodiments, the linear group includes one or more cleavable bond.

In certain embodiments, the linker includes the linear group covalently attached to a scaffold group. In certain embodiments, the scaffold includes a branched aliphatic group comprising groups selected from alkyl, amide, disulfide, polyethylene glycol, ether, thioether and hydroxylamino groups. In certain embodiments, the scaffold includes a branched aliphatic group comprising groups selected from alkyl, amide and ether groups. In certain embodiments, the scaffold includes at least one mono or polycyclic ring system. In certain embodiments, the scaffold includes at least two mono or polycyclic ring systems. In certain embodiments, the linear group is covalently attached to the scaffold group and the scaffold group is covalently attached to the cleavable moiety and the linker. In certain embodiments, the linear group is covalently attached to the scaffold group and the scaffold group is covalently attached to the cleavable moiety, the linker and a solid support. In certain embodiments, the linear group is covalently attached to the scaffold group and the scaffold group is covalently attached to the cleavable moiety, the linker and a protein binding moiety. In certain embodiments, the linear group is covalently attached to the scaffold group and the scaffold group is covalently attached to the cleavable moiety, the linker, a protein binding moiety and a solid support. In certain embodiments, the scaffold group includes one or more cleavable bond.

In certain embodiments, the linker includes a protein binding moiety. In certain embodiments, the protein binding moiety is a lipid such as for example including but not limited to cholesterol, cholic acid, adamantane acetic acid, 1-pyrene butyric acid, dihydrotestosterone, 1,3-Bis-O(hexadecyl) glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid. In certain embodiments, the protein binding moiety is a C16 to C22 long chain saturated or unsaturated fatty acid, cholesterol, cholic acid, vitamin E, adamantane or 1-pentafluoropropyl.

In certain embodiments, a linker has a structure selected from among:

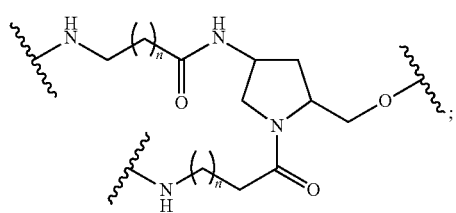

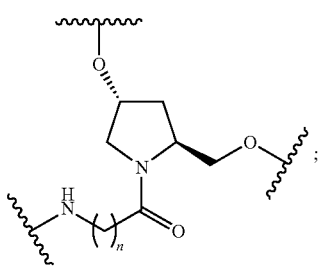

165
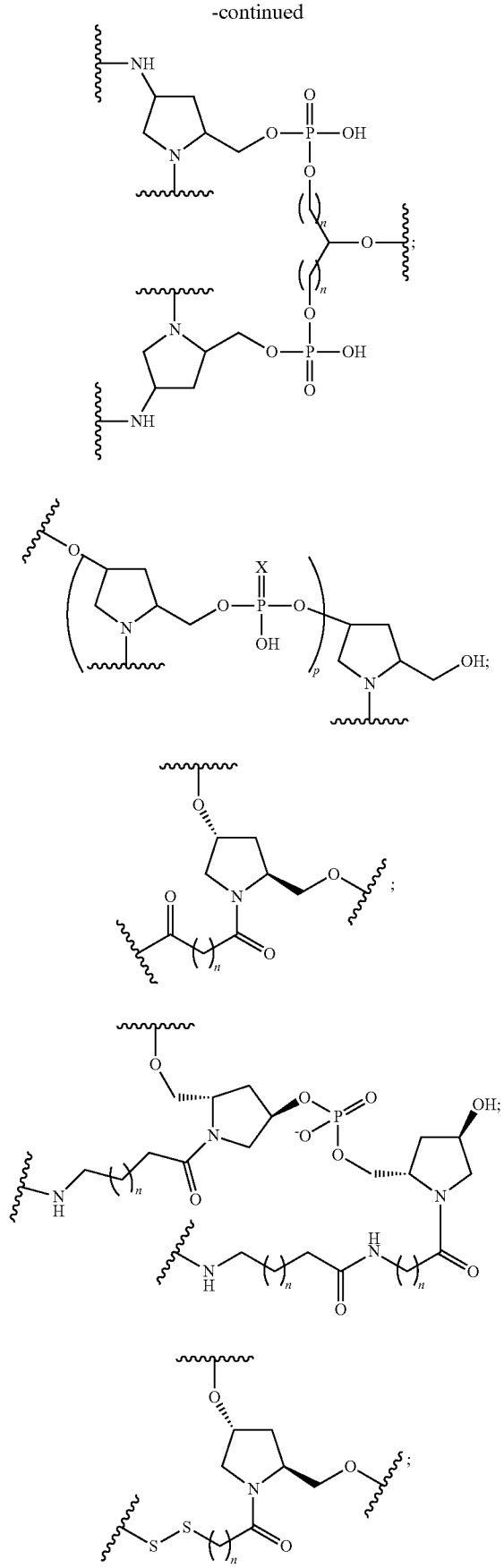
166
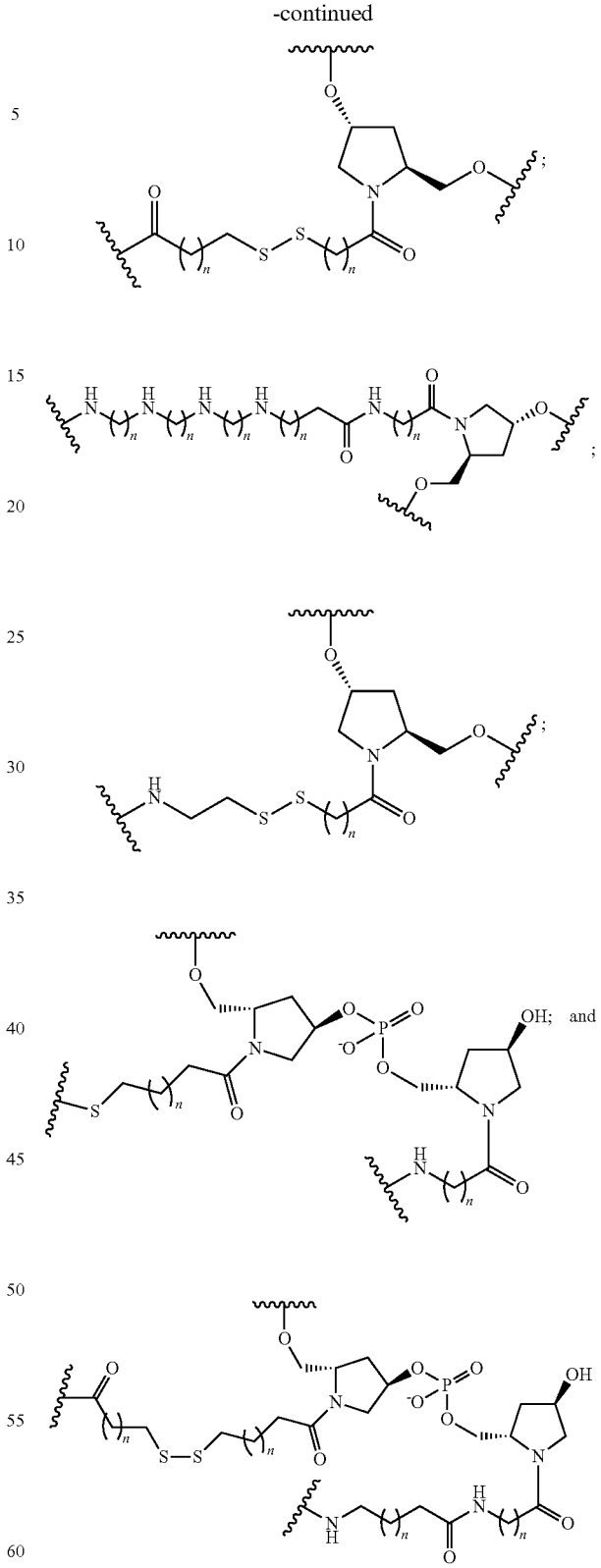
wherein each n is, independently, from 1 to 20; and p is from 1 to 6.
In certain embodiments, a linker has a structure selected from among:

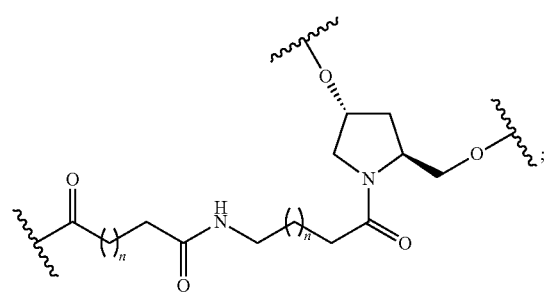
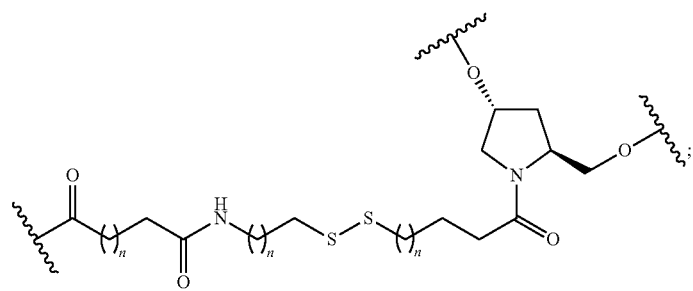
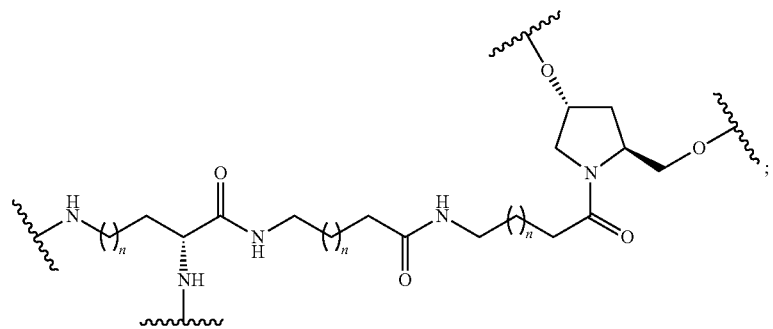
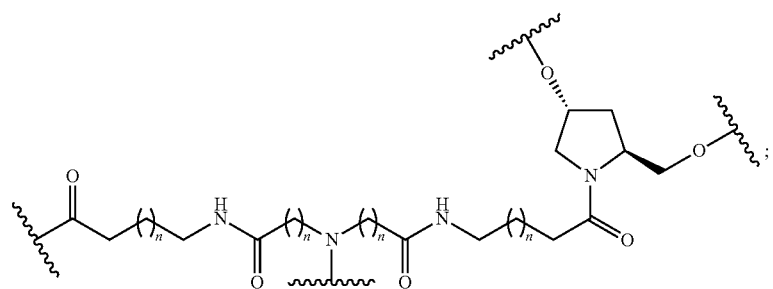
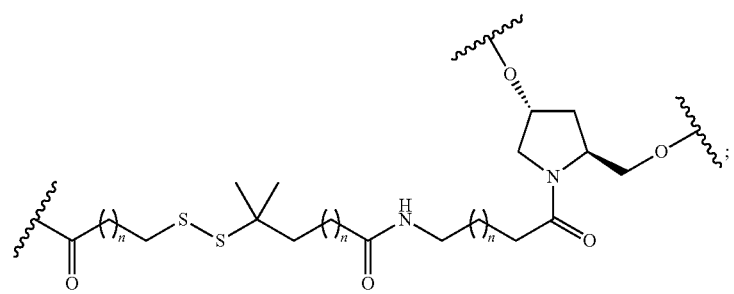

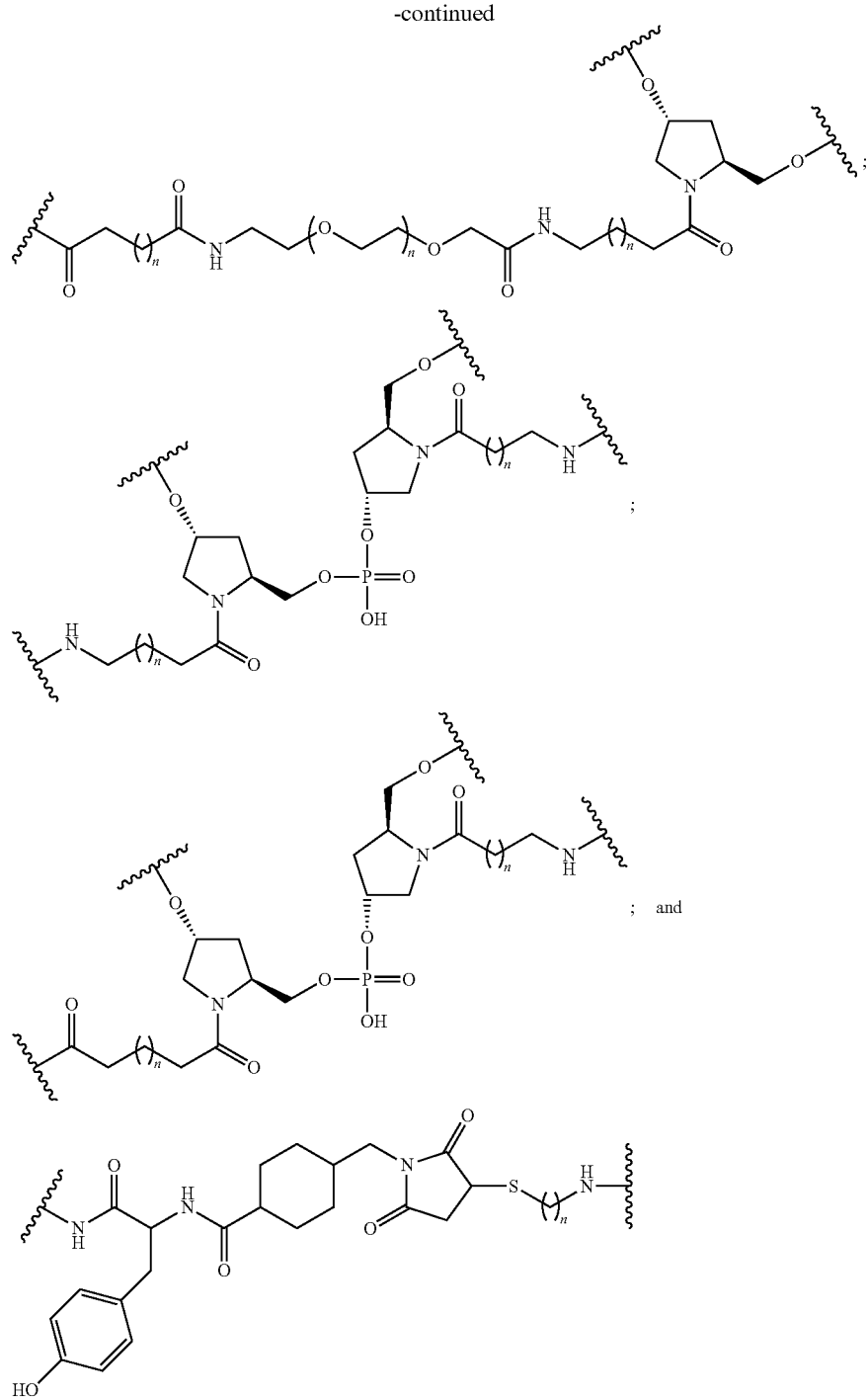
wherein each n is, independently, from 1 to 20.
In certain embodiments, a linker has a structure selected from among:
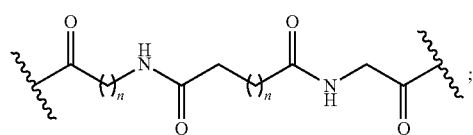
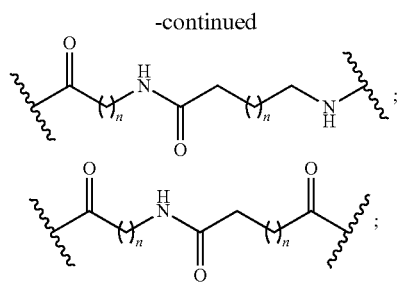

171
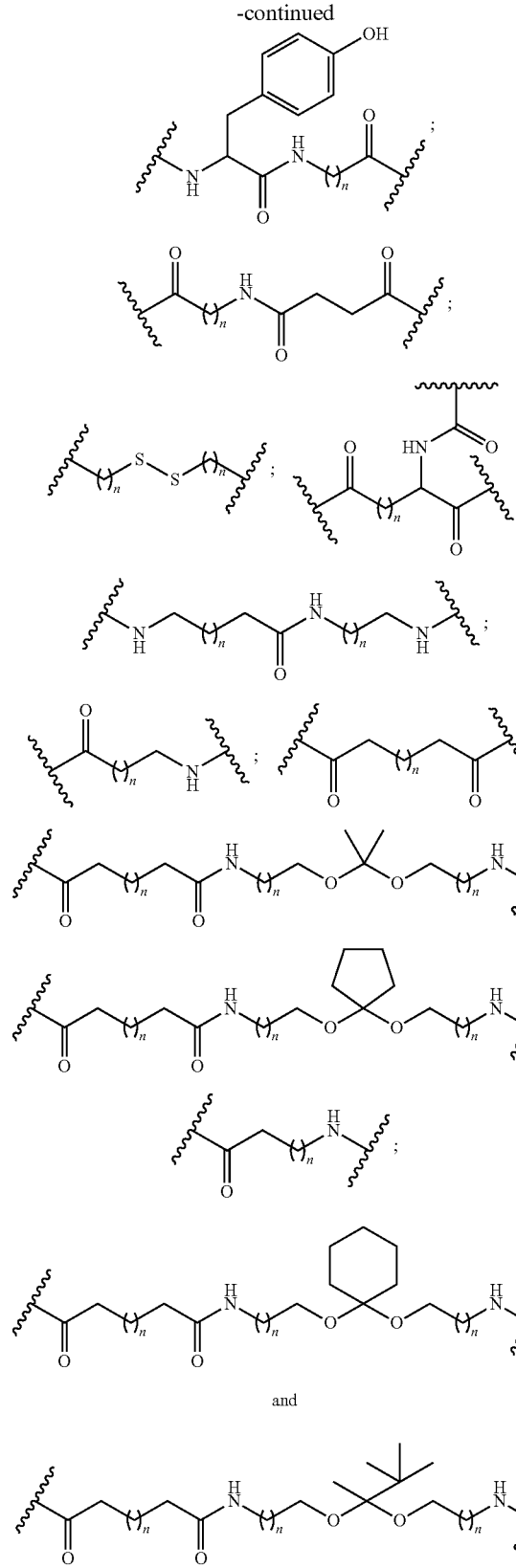
wherein n is from 1 to 20.
In certain embodiments, a linker has a structure selected from among:
172
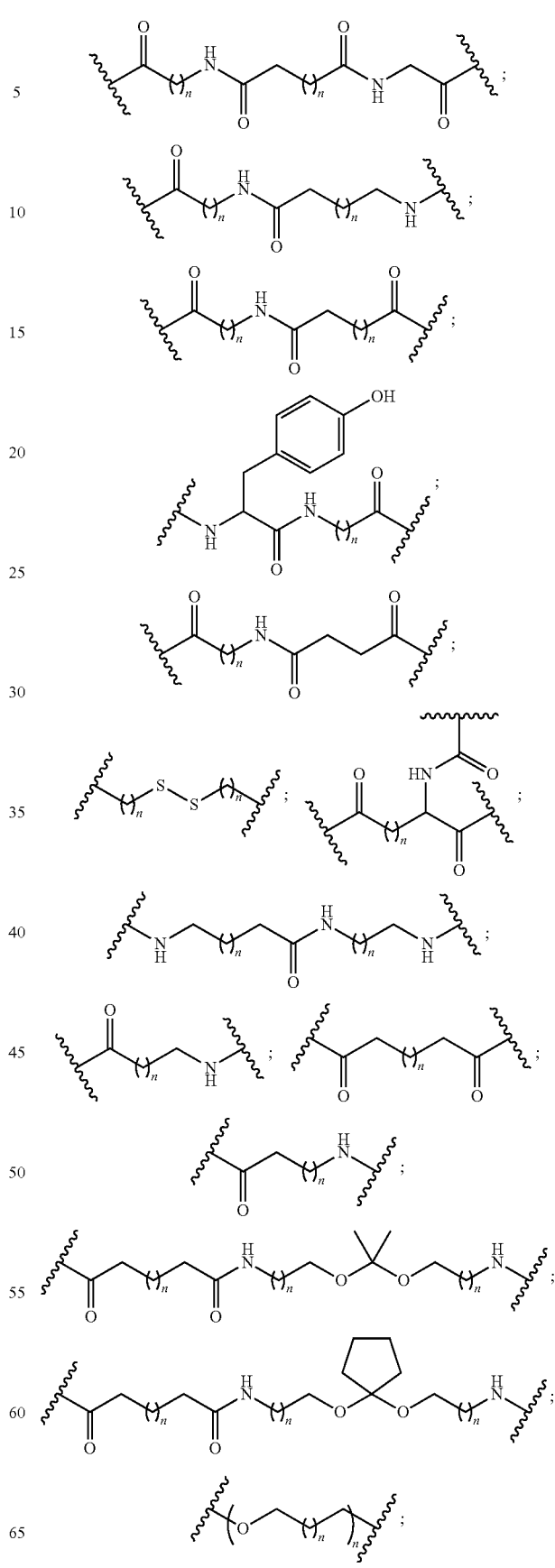

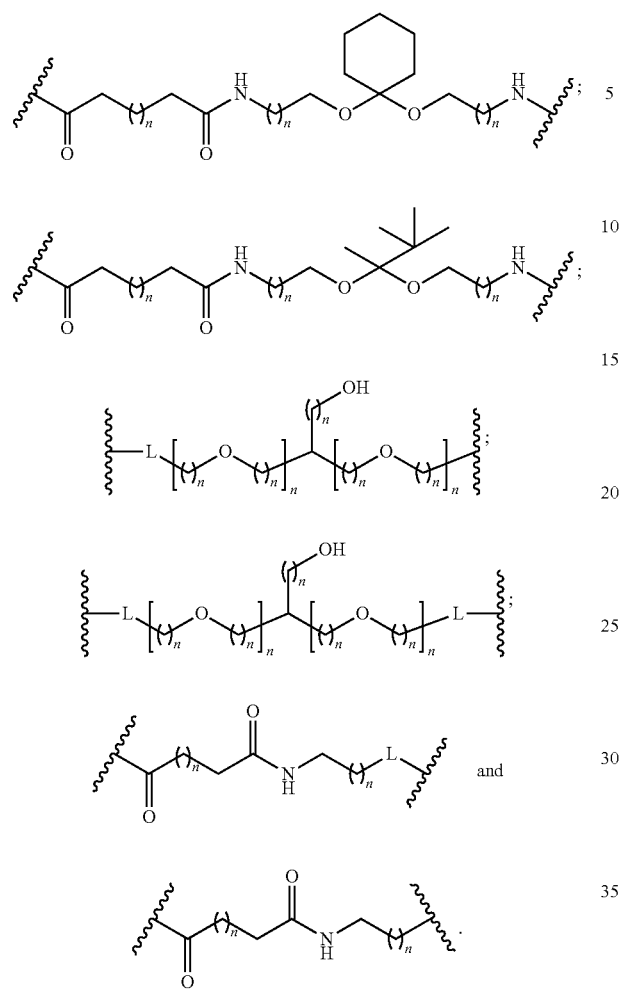
wherein each L is, independently, a phosphorus linking group or a neutral linking group; and each n is, independently, from 1 to 20.
In certain embodiments, a linker has a structure selected from among:
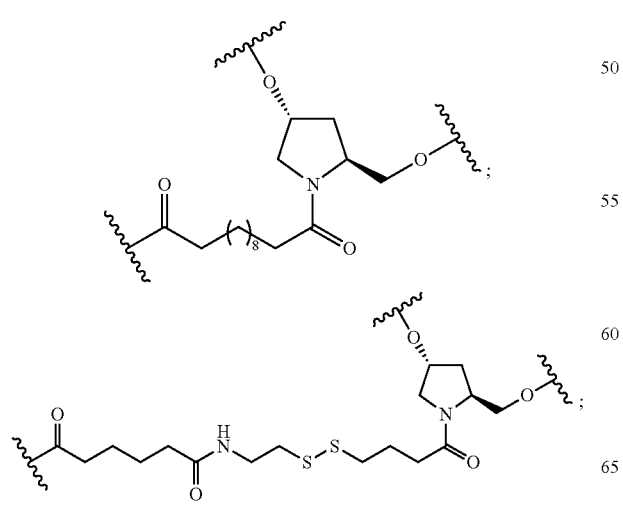
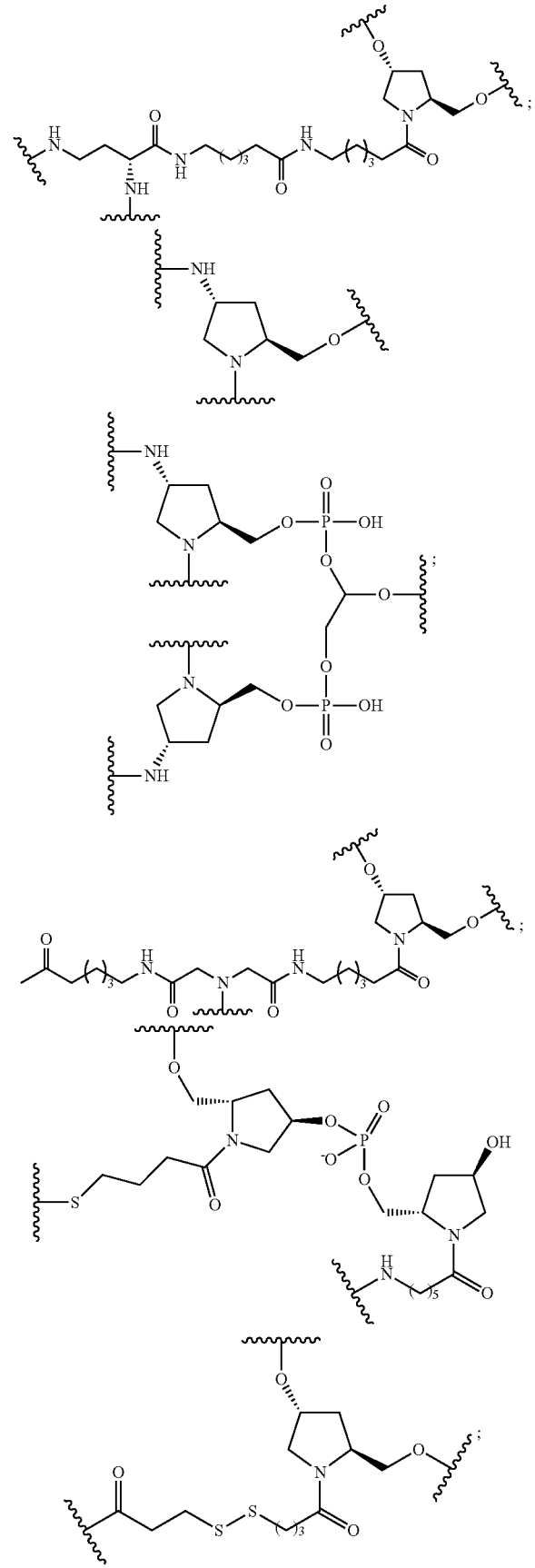

175
-continued
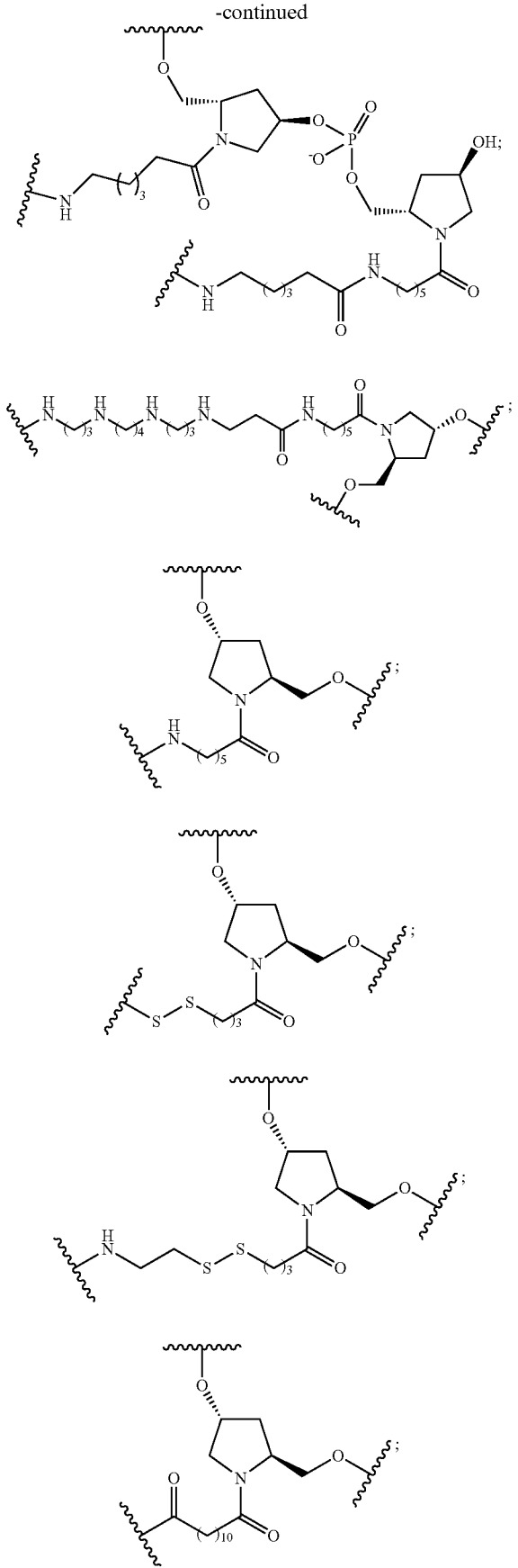
176
-continued
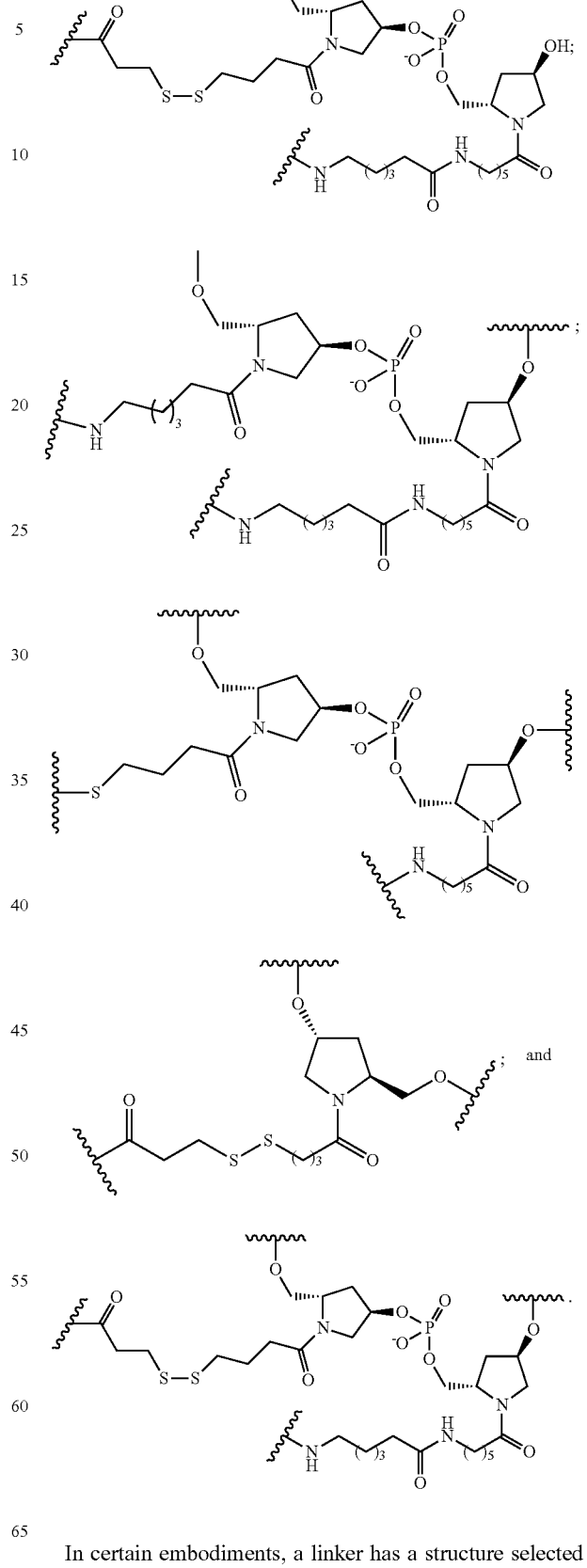
In certain embodiments, a linker has a structure selected from among:

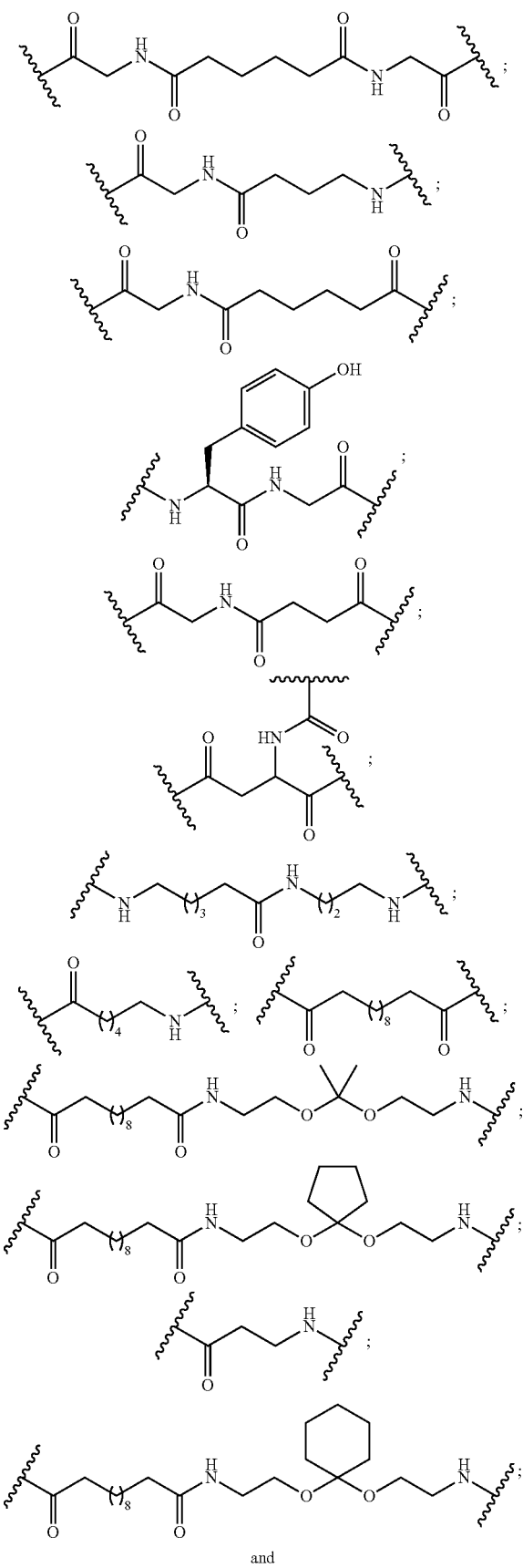
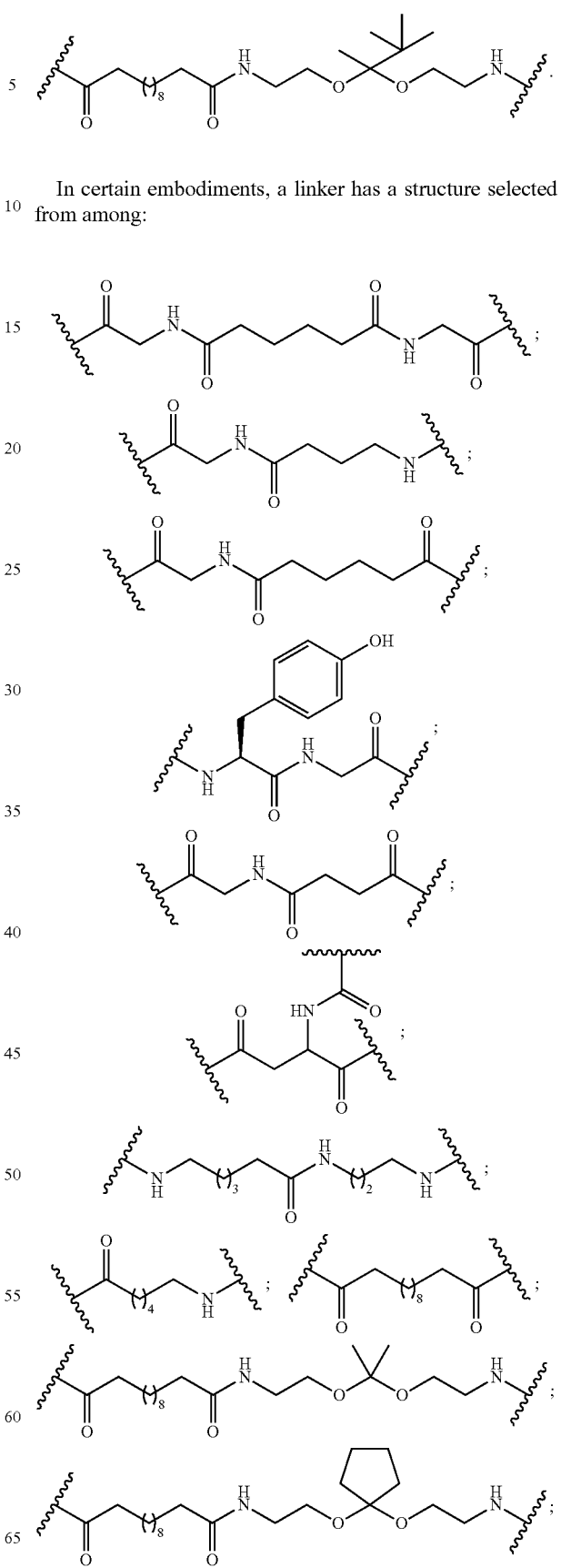
-continued
In certain embodiments, a linker has a structure selected from among:
and

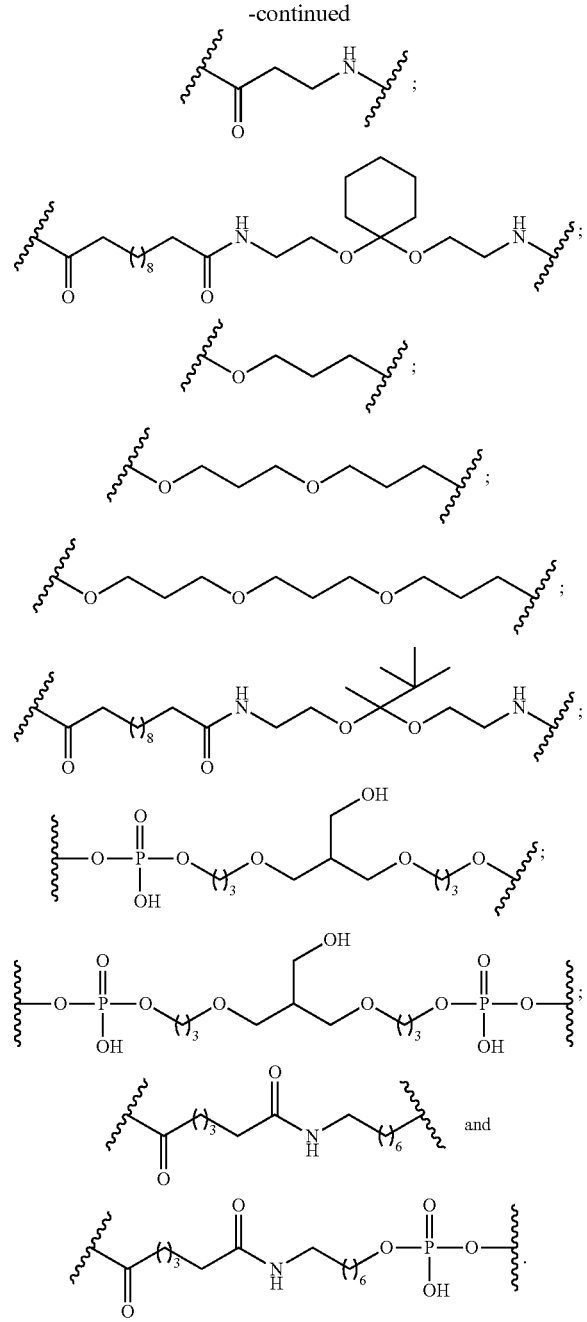

In certain embodiments, a linker has a structure selected from among:

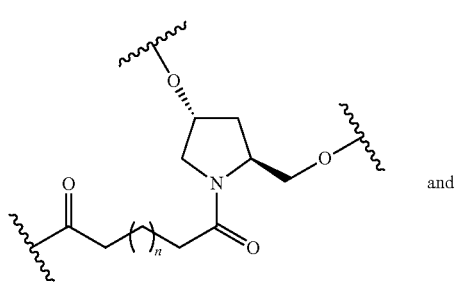

and

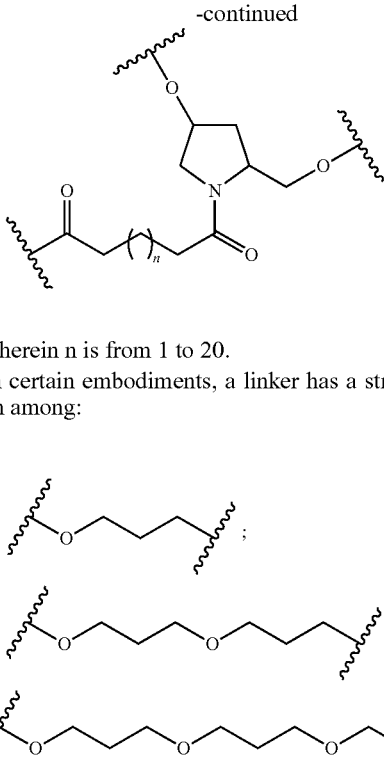

wherein n is from 1 to 20.

In certain embodiments, a linker has a structure selected from among:

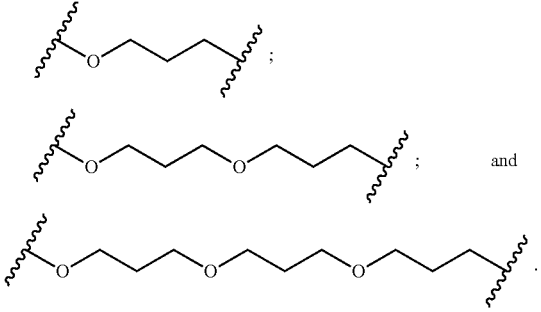

In certain embodiments, a linker has a structure selected from among:

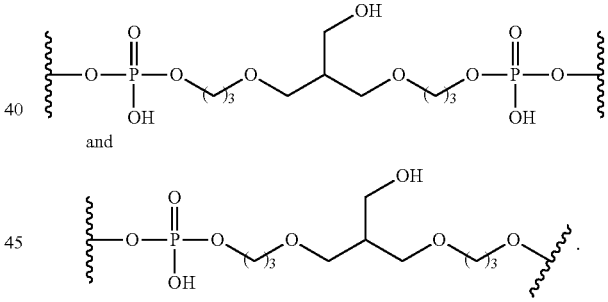

In certain embodiments, a linker has a structure selected from among:

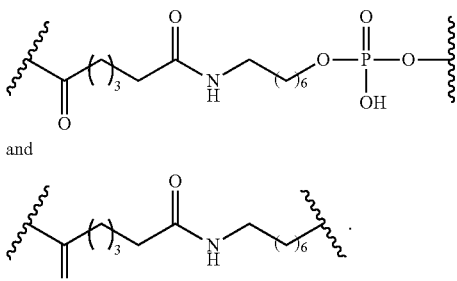

In certain embodiments, the conjugate linker has the structure:

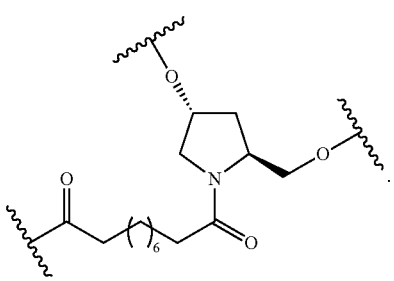

In certain embodiments, the conjugate linker has the structure:

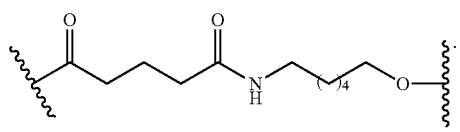

In certain embodiments, a linker has a structure selected from among:

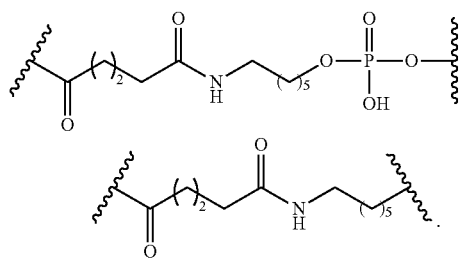

In certain embodiments, a linker has a structure selected from among:

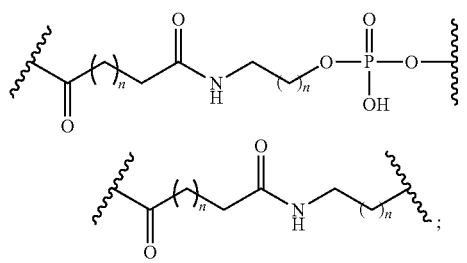

wherein each n is independently, 0, 1, 2, 3, 4, 5, 6, or 7.

ii. Certain Cell-Targeting Moieties

In certain embodiments, conjugate groups comprise cell-targeting moieties. Certain such cell-targeting moieties increase cellular uptake of antisense compounds. In certain embodiments, cell-targeting moieties comprise a branching group, one or more tether, and one or more ligand. In certain embodiments, cell-targeting moieties comprise a branching group, one or more tether, one or more ligand and one or more cleavable bond.

1. Certain Branching Groups

In certain embodiments, the conjugate groups comprise a targeting moiety comprising a branching group and at least two tethered ligands. In certain embodiments, the branching group attaches the conjugate linker. In certain embodiments, the branching group attaches the cleavable moiety. In certain embodiments, the branching group attaches the antisense oligonucleotide. In certain embodiments, the branching group is covalently attached to the linker and each of the tethered ligands. In certain embodiments, the branching group comprises a branched aliphatic group comprising groups selected from alkyl, amide, disulfide, polyethylene glycol, ether, thioether and hydroxylamino groups. In certain embodiments, the branching group comprises groups selected from alkyl, amide and ether groups. In certain embodiments, the branching group comprises groups selected from alkyl and ether groups. In certain embodiments, the branching group comprises a mono or polycyclic ring system. In certain embodiments, the branching group comprises one or more cleavable bond. In certain embodiments, the conjugate group does not include a branching group.

In certain embodiments, a branching group has a structure selected from among:

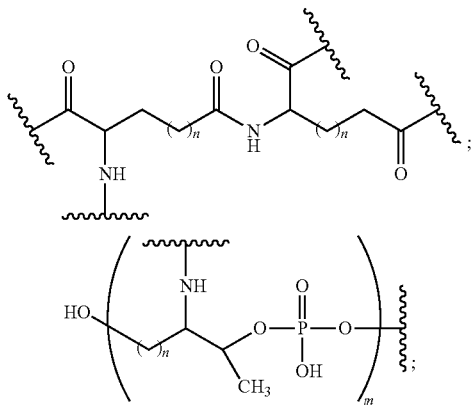

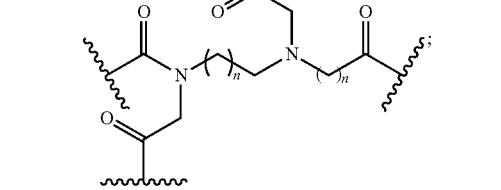

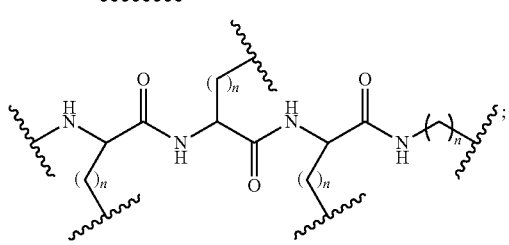

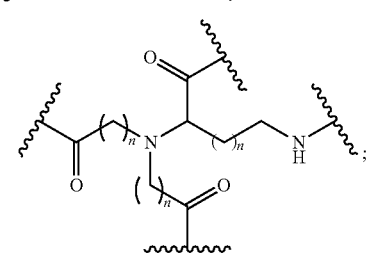

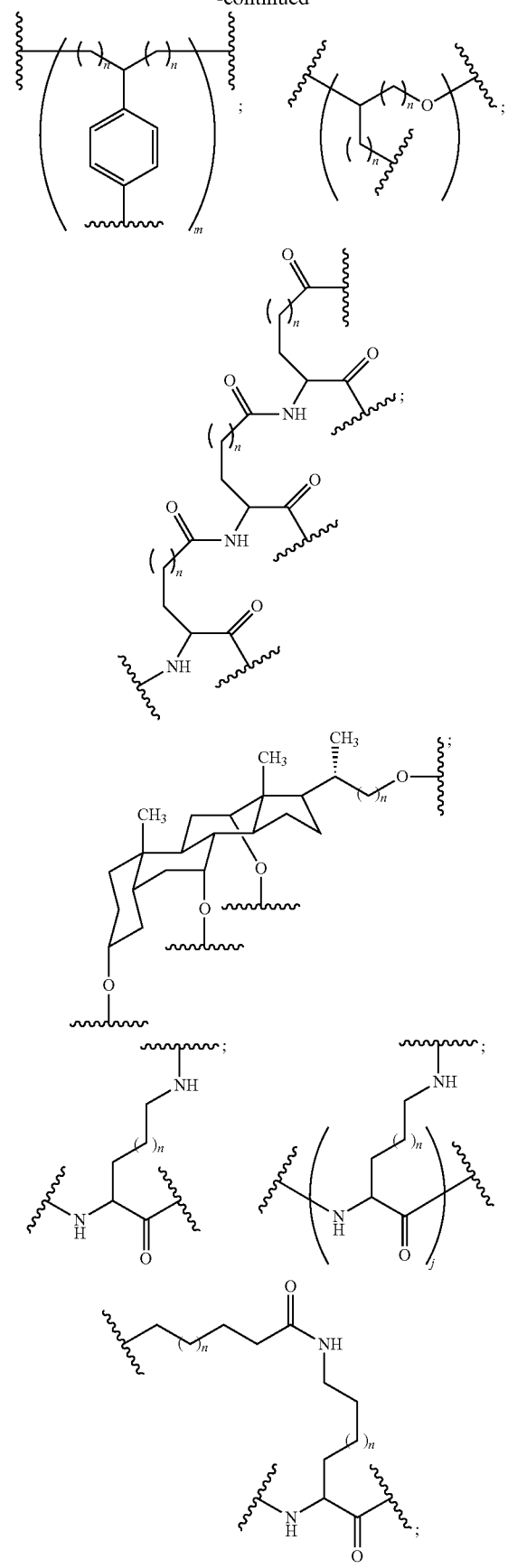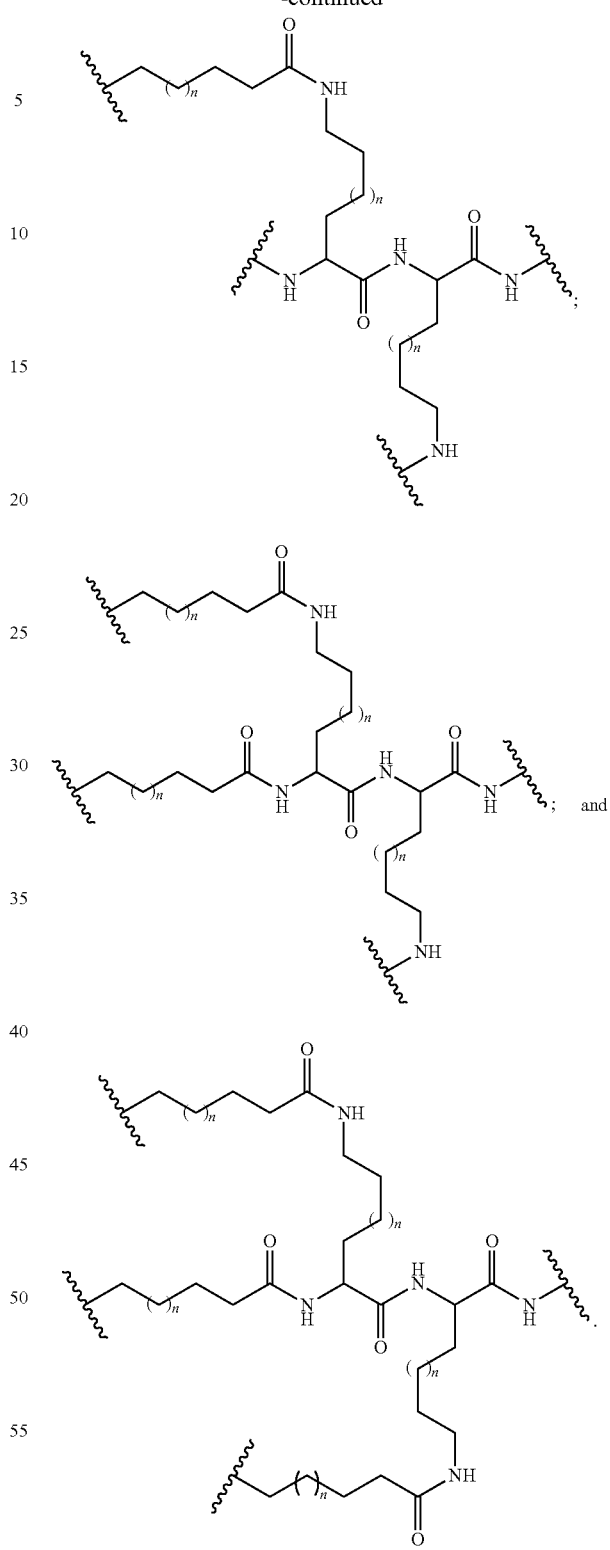
wherein each n is, independently, from 1 to 20;
j is from 1 to 3; and
m is from 2 to 6.
In certain embodiments, a branching group has a structure selected from among:

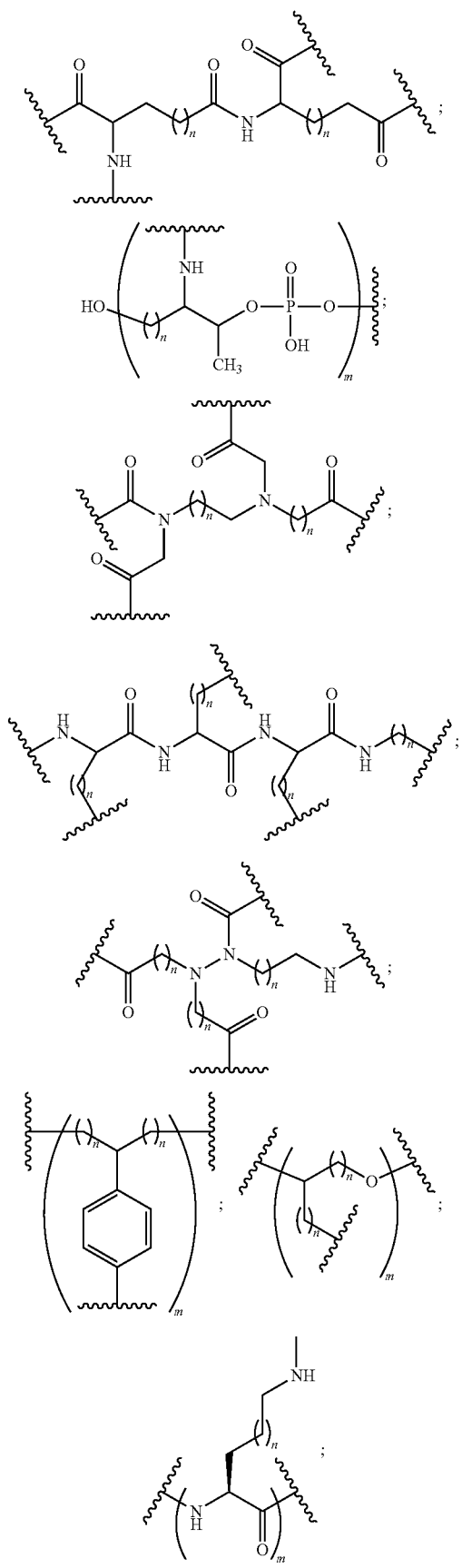
wherein each n is, independently, from 1 to 20; and m is from 2 to 6.
In certain embodiments, a branching group has a structure selected from among:

187
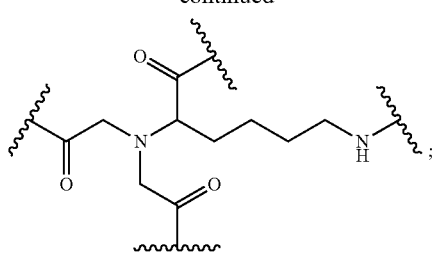
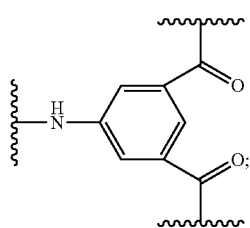
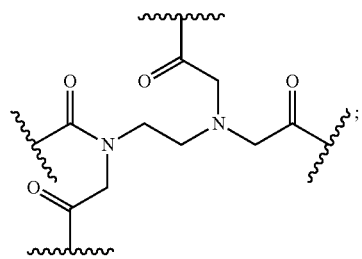
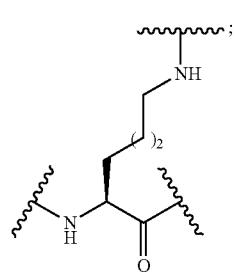
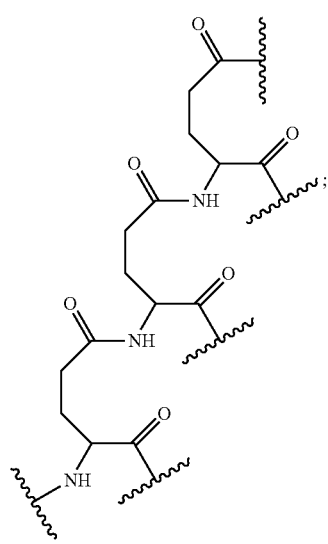
188
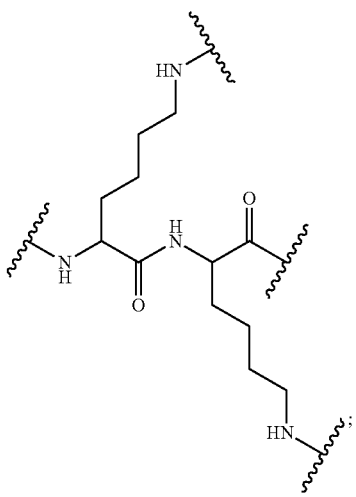
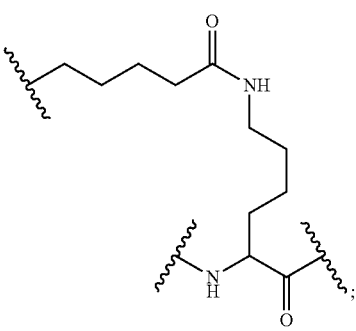
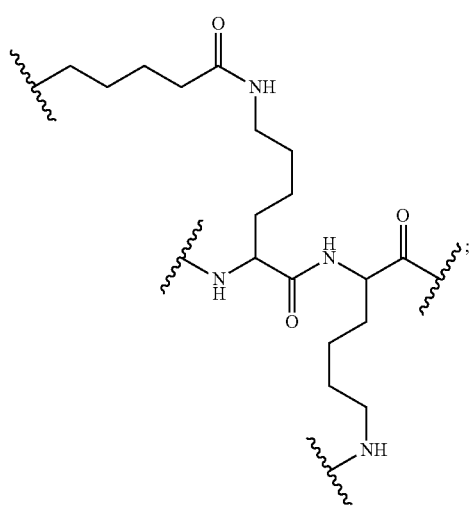

-continued

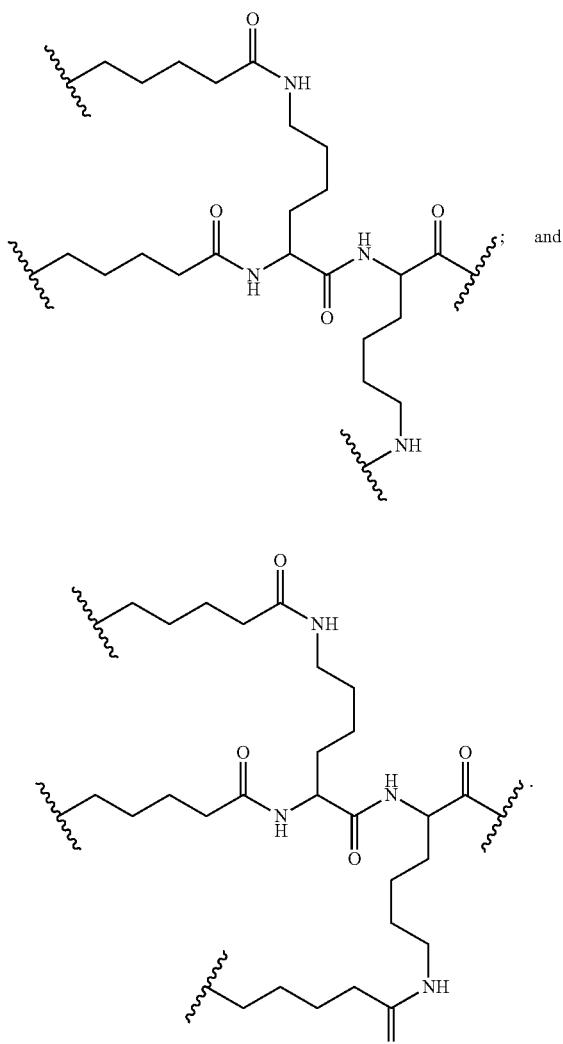

In certain embodiments, a branching group has a structure selected from among:

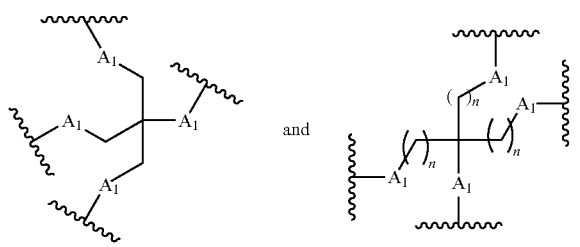

wherein each $A_1$ is independently, O, S, C=O or NH; and each n is, independently, from 1 to 20.

In certain embodiments, a branching group has a structure selected from among:

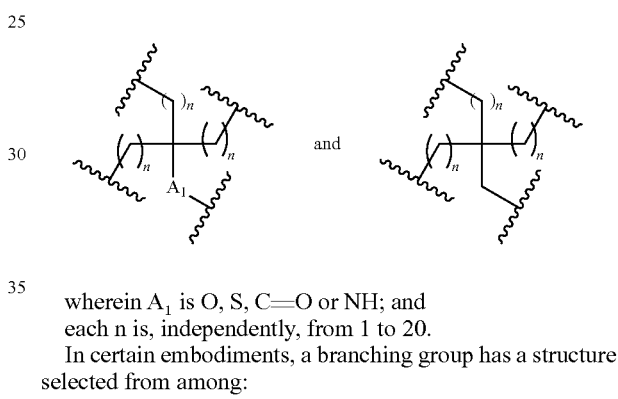

wherein each $A_1$ is independently, O, S, C=O or NH; and each n is, independently, from 1 to 20.

In certain embodiments, a branching group has a structure selected from among:

wherein $A_1$ is O, S, C=O or NH; and each n is, independently, from 1 to 20.

In certain embodiments, a branching group has a structure selected from among:

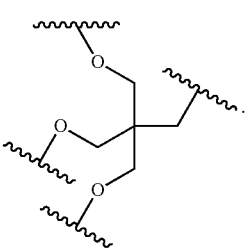 [SMILES: *CC(CO*)(CO*)CO*]

In certain embodiments, a branching group has a structure selected from among:

In certain embodiments, a branching group has a structure selected from among:

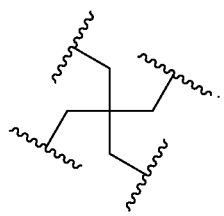 [SMILES: *CC(C*)(C*)C*]

2. Certain Tethers

In certain embodiments, conjugate groups comprise one or more tethers covalently attached to the branching group. In certain embodiments, conjugate groups comprise one or more tethers covalently attached to the linking group. In certain embodiments, each tether is a linear aliphatic group comprising one or more groups selected from alkyl, ether, thioether, disulfide, amide and polyethylene glycol groups in any combination. In certain embodiments, each tether is a linear aliphatic group comprising one or more groups selected from alkyl, substituted alkyl, ether, thioether, disulfide, amide, phosphodiester and polyethylene glycol groups in any combination. In certain embodiments, each tether is a linear aliphatic group comprising one or more groups selected from alkyl, ether and amide groups in any combination. In certain embodiments, each tether is a linear aliphatic group comprising one or more groups selected from alkyl, substituted alkyl, phosphodiester, ether and amide groups in any combination. In certain embodiments, each tether is a linear aliphatic group comprising one or more groups selected from alkyl and phosphodiester in any combination. In certain embodiments, each tether comprises at least one phosphorus linking group or neutral linking group.

In certain embodiments, the tether includes one or more cleavable bond. In certain embodiments, the tether is attached to the branching group through either an amide or an ether group. In certain embodiments, the tether is attached to the branching group through a phosphodiester group. In certain embodiments, the tether is attached to the branching group through a phosphorus linking group or neutral linking group. In certain embodiments, the tether is attached to the branching group through an ether group. In certain embodiments, the tether is attached to the ligand through either an amide or an ether group. In certain embodiments, the tether is attached to the ligand through an ether group. In certain embodiments, the tether is attached to the ligand through either an amide or an ether group. In certain embodiments, the tether is attached to the ligand through an ether group.

In certain embodiments, each tether comprises from about 8 to about 20 atoms in chain length between the ligand and the branching group. In certain embodiments, each tether group comprises from about 10 to about 18 atoms in chain length between the ligand and the branching group. In certain embodiments, each tether group comprises about 13 atoms in chain length.

In certain embodiments, a tether has a structure selected from among:

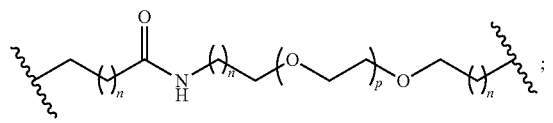

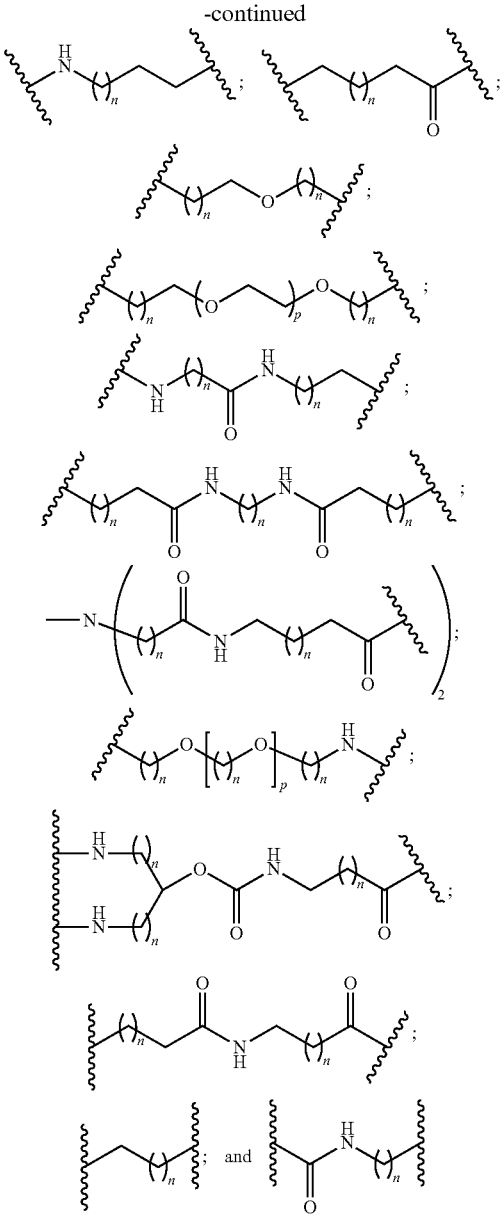

wherein each n is, independently, from 1 to 20; and each p is from 1 to about 6.

In certain embodiments, a tether has a structure selected from among:

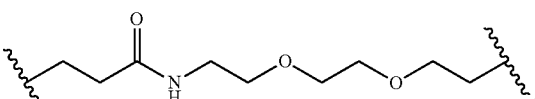

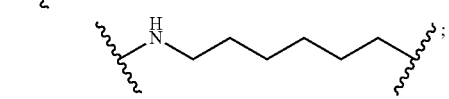

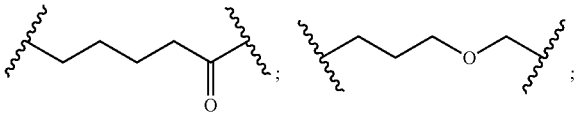

-continued

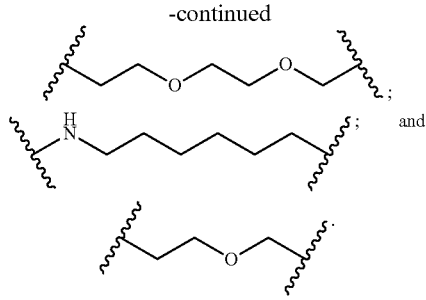

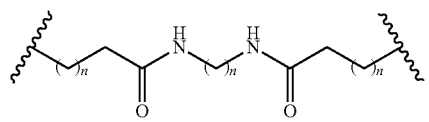

In certain embodiments, a tether has a structure selected from among:

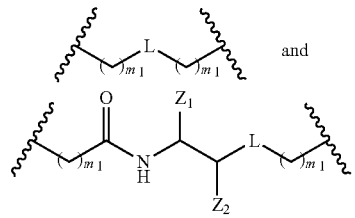

wherein each n is, independently, from 1 to 20.

In certain embodiments, a tether has a structure selected from among:

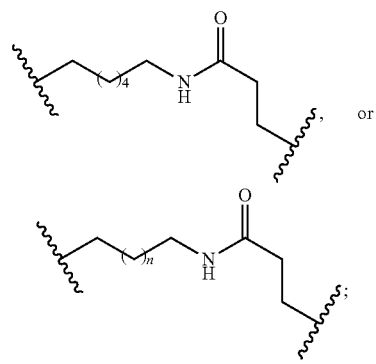

wherein L is either a phosphorus linking group or a neutral linking group;

$Z_1$ is C(=O)O—$R_2$;

$Z_2$ is H, $C_1$-$C_6$ alkyl or substituted $C_1$-$C_6$ alky;

$R_2$ is H, $C_1$-$C_6$ alkyl or substituted $C_1$-$C_6$ alky; and each $m_1$ is, independently, from 0 to 20 wherein at least one $m_1$ is greater than 0 for each tether.

In certain embodiments, a tether has a structure selected from among:

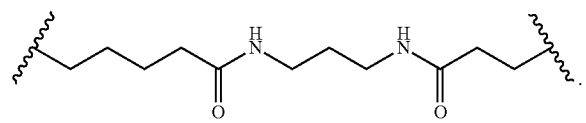 [SMILES: *CCCCC(=O)NCCCNC(=O)CC*]

In certain embodiments, a tether has a structure selected from among:

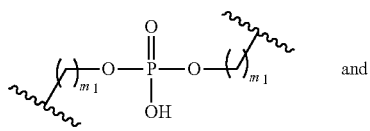

-continued

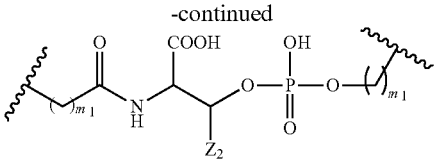

wherein $Z_2$ is H or $CH_3$; and each $m_1$ is, independently, from 0 to 20 wherein at least one $m_1$ is greater than 0 for each tether.

In certain embodiments, a tether has a structure selected from among:

wherein each n is independently, 0, 1, 2, 3, 4, 5, 6, or 7.

In certain embodiments, a tether comprises a phosphorus linking group. In certain embodiments, a tether does not comprise any amide bonds. In certain embodiments, a tether comprises a phosphorus linking group and does not comprise any amide bonds.

3. Certain Ligands

In certain embodiments, the present disclosure provides ligands wherein each ligand is covalently attached to a tether. In certain embodiments, each ligand is selected to have an affinity for at least one type of receptor on a target cell. In certain embodiments, ligands are selected that have an affinity for at least one type of receptor on the surface of a mammalian liver cell. In certain embodiments, ligands are selected that have an affinity for the hepatic asialoglycoprotein receptor (ASGP-R). In certain embodiments, each ligand is a carbohydrate. In certain embodiments, each ligand is, independently selected from galactose, N-acetyl galactoseamine, mannose, glucose, glucosamone and fucose. In certain embodiments, each ligand is N-acetyl galactoseamine (GalNAc). In certain embodiments, the targeting moiety comprises 2 to 6 ligands. In certain embodiments, the targeting moiety comprises 3 ligands. In certain embodiments, the targeting moiety comprises 3 N-acetyl galactoseamine ligands.

In certain embodiments, the ligand is a carbohydrate, carbohydrate derivative, modified carbohydrate, multivalent carbohydrate cluster, polysaccharide, modified polysaccharide, or polysaccharide derivative. In certain embodiments, the ligand is an amino sugar or a thio sugar. For example, amino sugars may be selected from any number of compounds known in the art, for example glucosamine, sialic acid, α-D-galactosamine, N-Acetylgalactosamine, 2-acetamido-2-deoxy-D-galactopyranose (GalNAc), 2-Amino-3-O-[(R)-1-carboxyethyl]-2-deoxy-β-D-glucopyranose (β-muramic acid), 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose and N-sulfo-D-glucosamine, and N-Glycoloyl-α-neuraminic acid. For example, thio sugars may be selected from the group consisting of 5-Thio-β-D-glucopyranose, Methyl 2,3,4-tri-O-acetyl-1-thio-6-O-trityl-α-D-glucopyranoside, 4-Thio-β-D-galactopyranose, and ethyl 3,4,6,7-tetra-O-acetyl-2-deoxy-1,5-dithio-α-D-gluco-heptopyranoside.

In certain embodiments, "GalNac" or "Gal-NAc" refers to 2-(Acetylamino)-2-deoxy-D-galactopyranose, commonly referred to in the literature as N-acetyl galactosamine. In certain embodiments, "N-acetyl galactosamine" refers to 2-(Acetylamino)-2-deoxy-D-galactopyranose. In certain embodiments, "GalNac" or "Gal-NAc" refers to 2-(Acetylamino)-2-deoxy-D-galactopyranose. In certain embodiments, "GalNac" or "Gal-NAc" refers to 2-(Acetylamino)-2-deoxy-D-galactopyranose, which includes both the β-form: 2-(Acetylamino)-2-deoxy-β-D-galactopyranose and α-form: 2-(Acetylamino)-2-deoxy-D-galactopyranose. In certain embodiments, both the β-form: 2-(Acetylamino)-2-deoxy-β-D-galactopyranose and α-form: 2-(Acetylamino)-2-deoxy-D-galactopyranose may be used interchangeably. Accordingly, in structures in which one form is depicted, these structures are intended to include the other form as well. For example, where the structure for an α-form: 2-(Acetylamino)-2-deoxy-D-galactopyranose is shown, this structure is intended to include the other form as well. In certain embodiments, In certain preferred embodiments, the β-form 2-(Acetylamino)-2-deoxy-D-galactopyranose is the preferred embodiment.

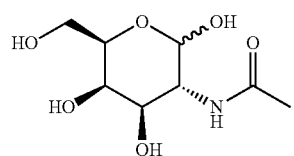

2-(Acetylamino)-2-deoxy-D-galactopyranose

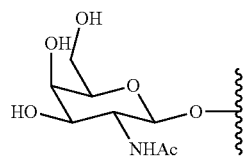

2-(Acetylamino)-2-deoxy-β-D-galactopyranose

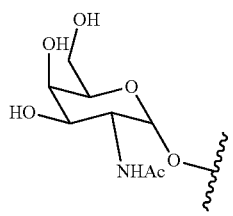

2-(Acetylamino)-2-deoxy-α-D-galactopyranose

In certain embodiments one or more ligand has a structure selected from among:

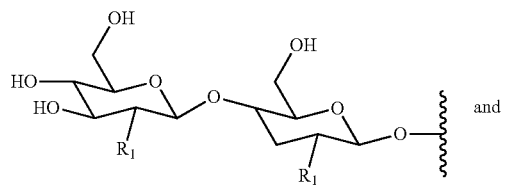

wherein each $R_1$ is selected from OH and NHCOOH.

In certain embodiments one or more ligand has a structure selected from among:

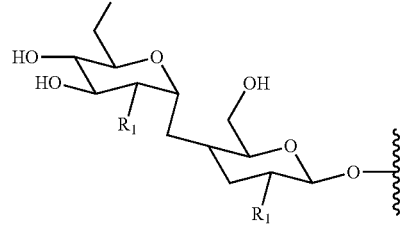

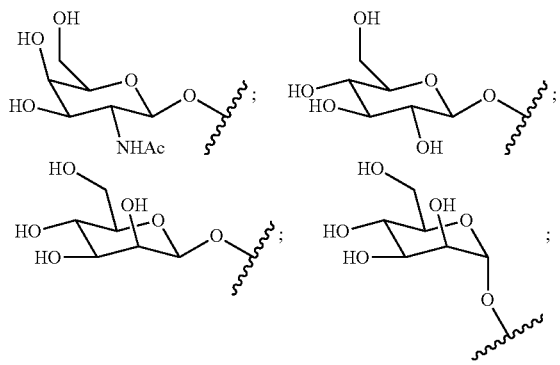

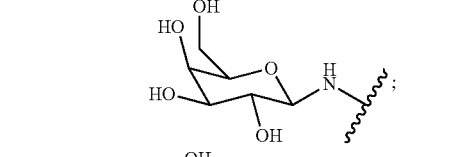

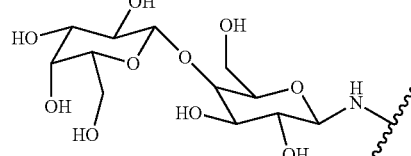

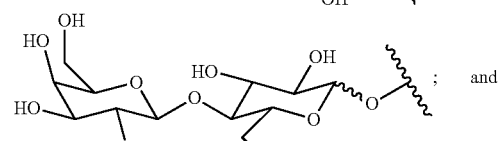

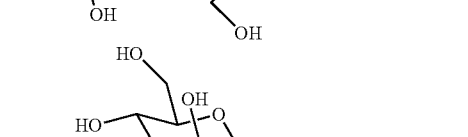

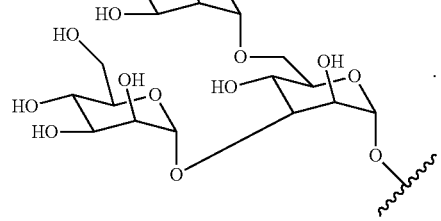

In certain embodiments one or more ligand has a structure selected from among:

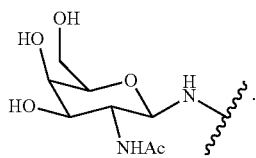 [SMILES: *NC1OC(CO)C(O)C(O)C1NC(C)=O]

In certain embodiments one or more ligand has a structure selected from among:

iii. Certain Conjugates

In certain embodiments, conjugate groups comprise the structural features above. In certain such embodiments, conjugate groups comprise the following structure:

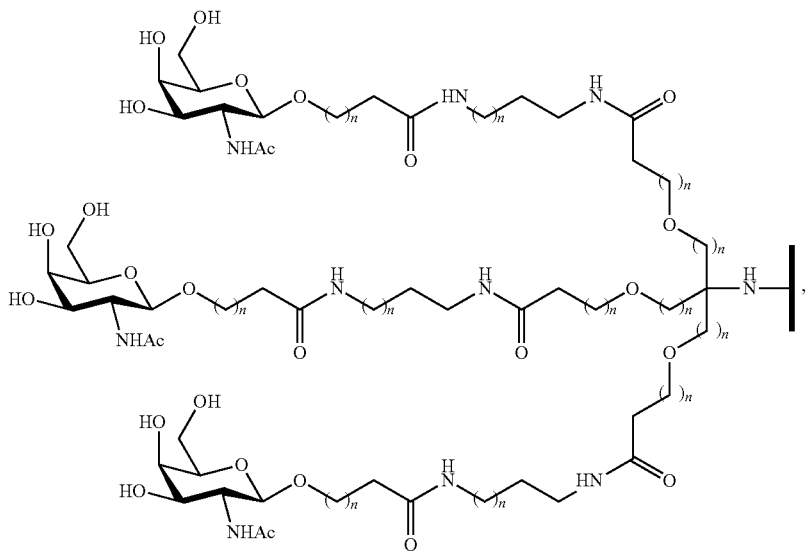

wherein each n is, independently, from 1 to 20.

In certain such embodiments, conjugate groups comprise the following structure:

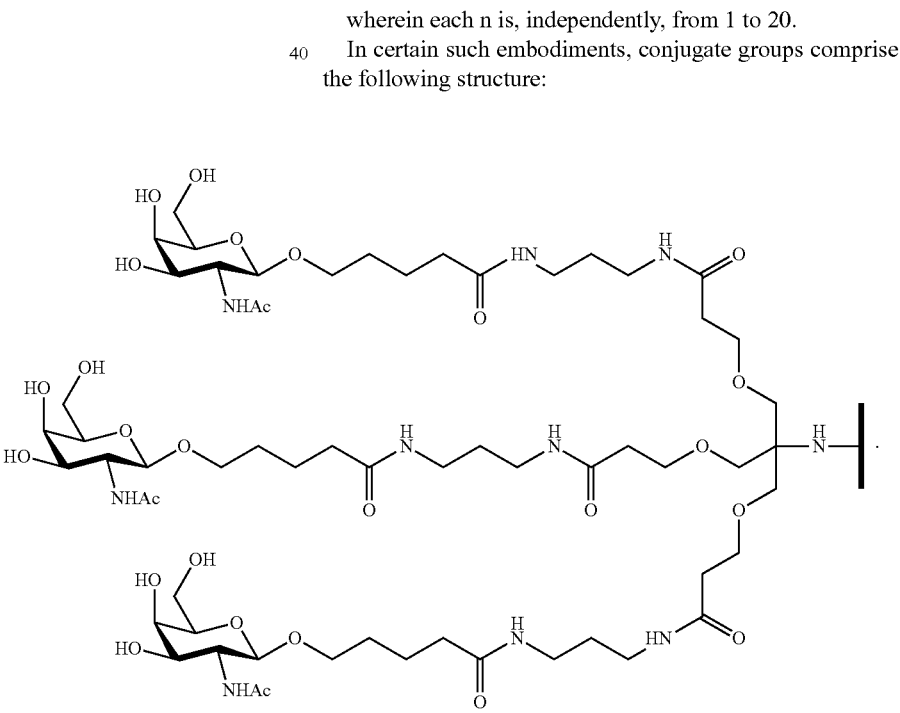

In certain such embodiments, conjugate groups have the following structure:
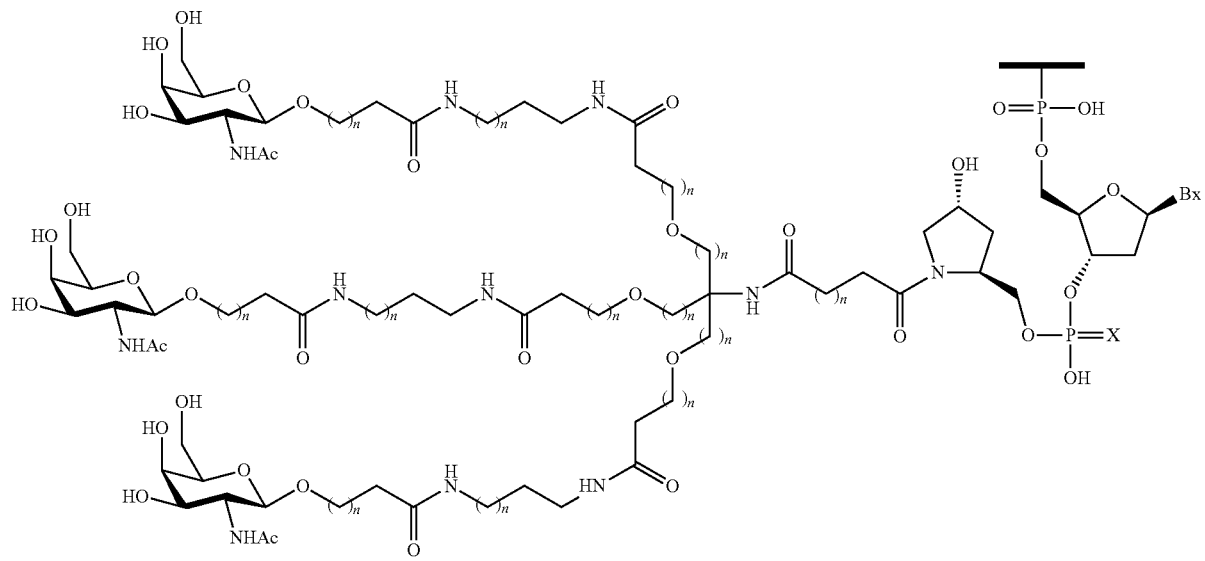
wherein each n is, independently, from 1 to 20;
Z is H or a linked solid support;
Q is an antisense compound;
X is O or S; and
Bx is a heterocyclic base moiety.
In certain such embodiments, conjugate groups have the following structure:
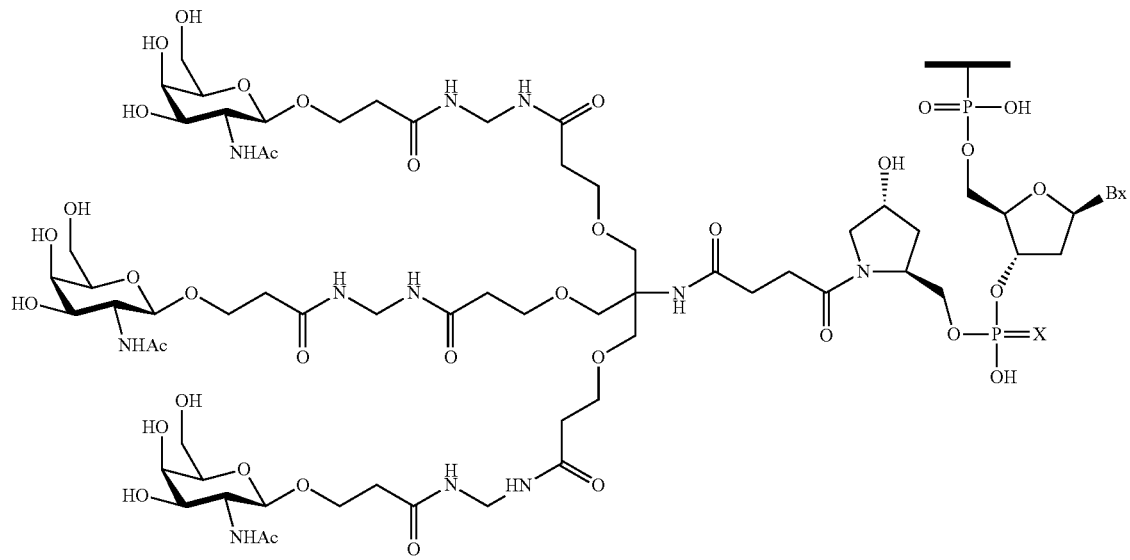

In certain such embodiments, conjugate groups have the following structure:
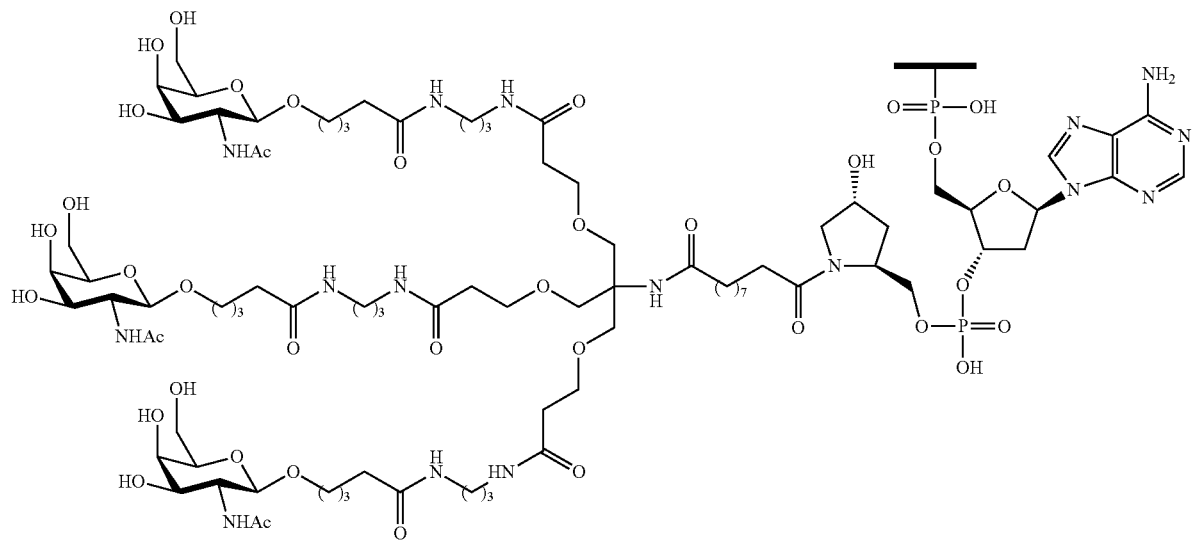
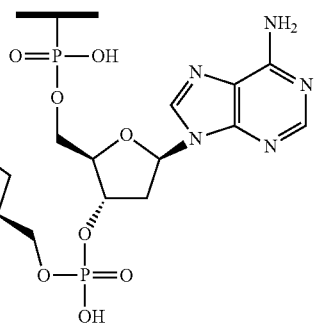
In certain such embodiments, conjugate groups comprise the following structure:
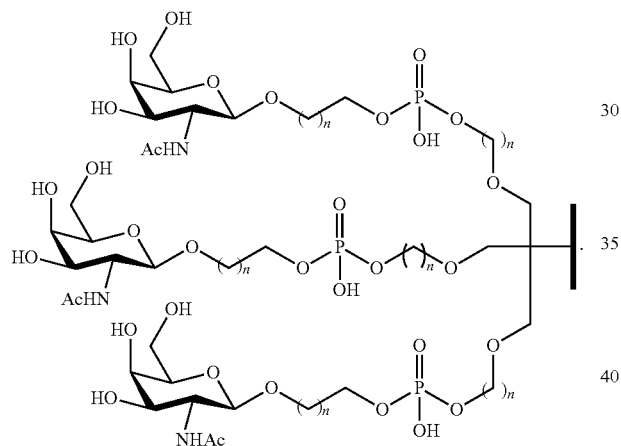
In certain such embodiments, conjugate groups comprise the following structure:
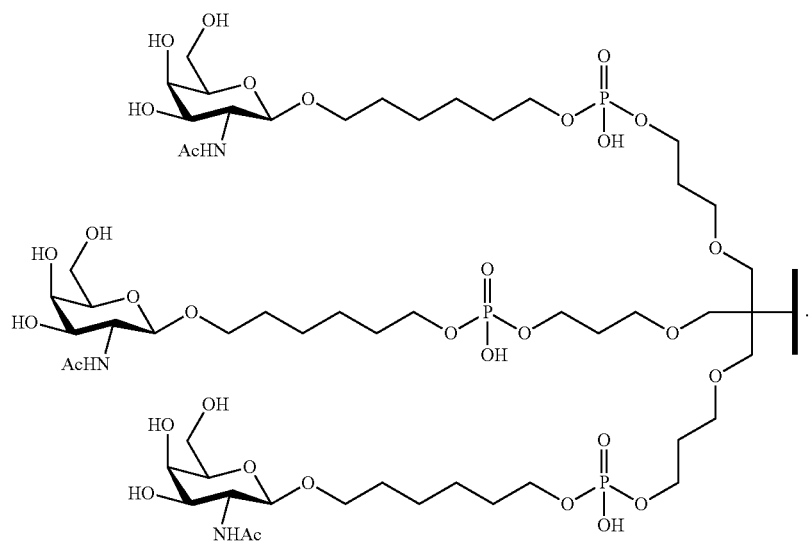

In certain such embodiments, conjugate groups have the following structure:
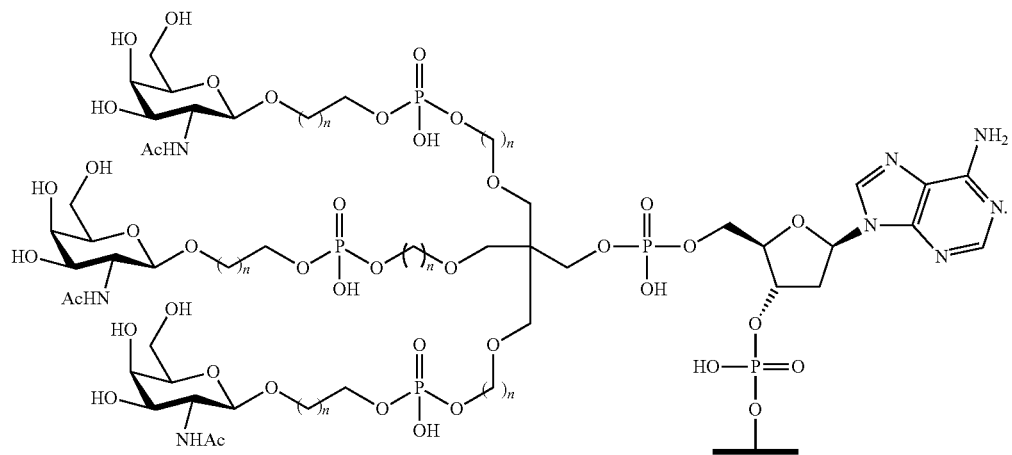
In certain such embodiments, conjugate groups have the following structure:
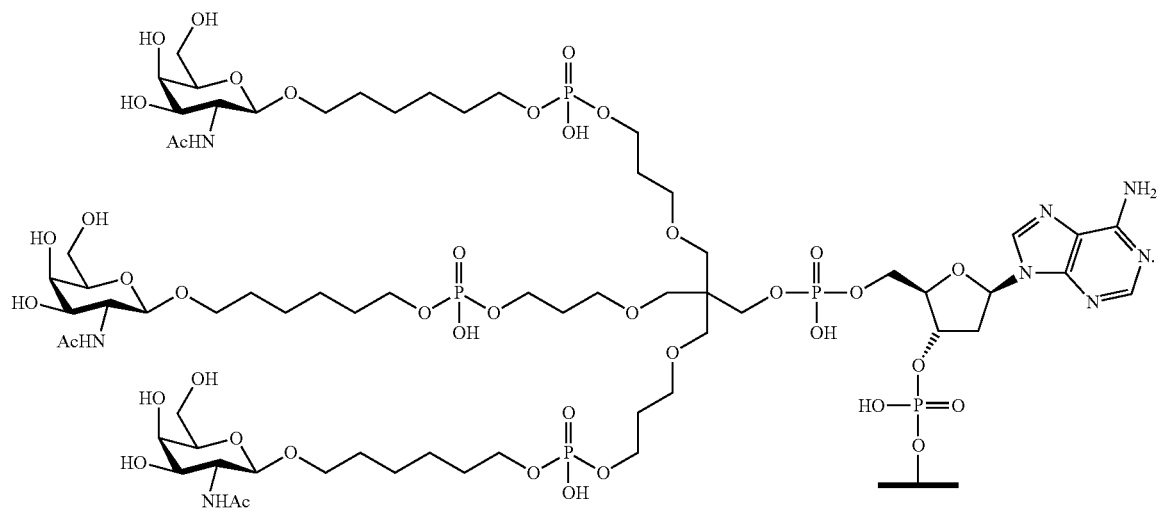
In certain such embodiments, conjugate groups have the following structure:
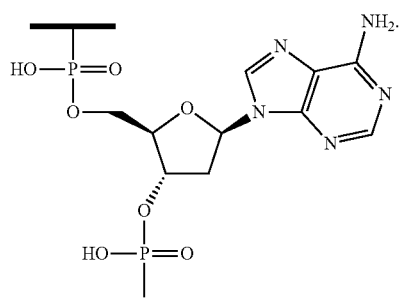

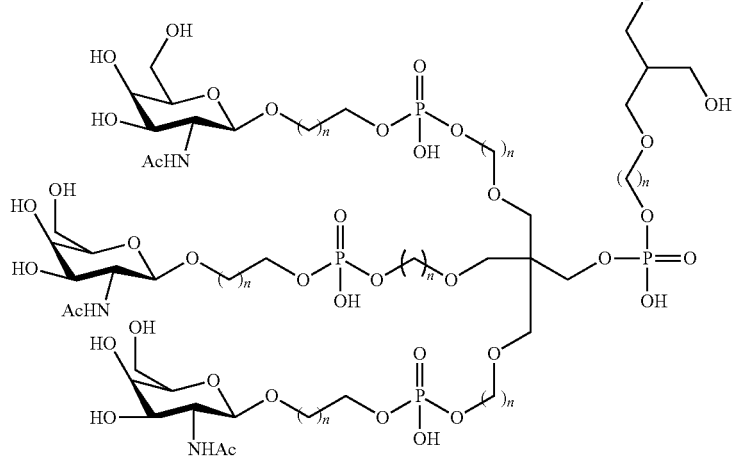
25
In certain such embodiments, conjugate groups have the following structure:
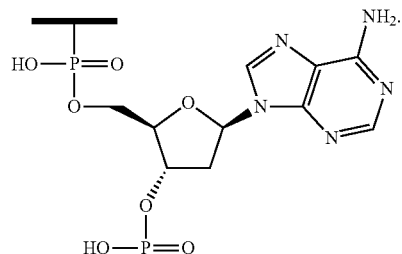
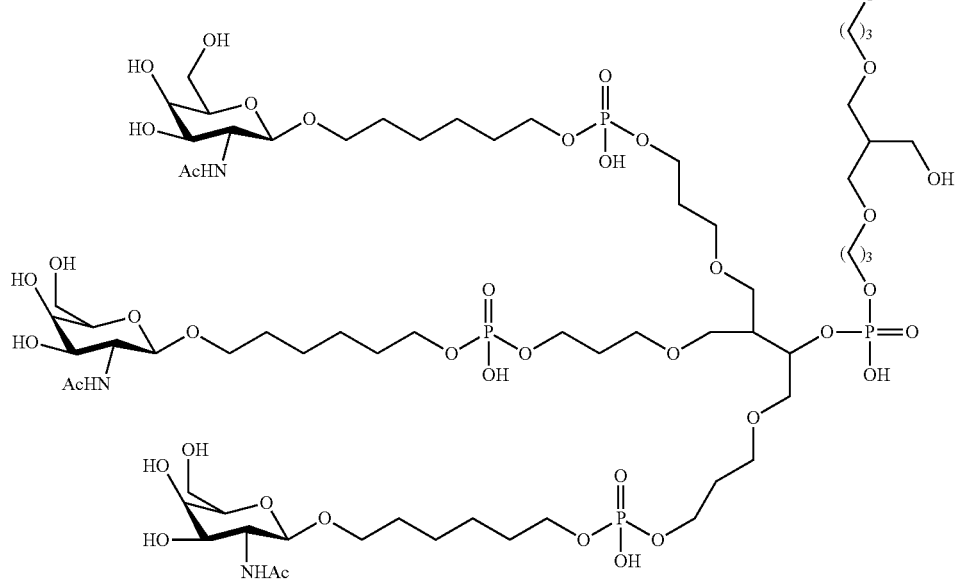

In certain embodiments, conjugates do not comprise a pyrrolidine.

b. Certain Conjugated Antisense Compounds

In certain embodiments, the conjugates are bound to a nucleoside of the antisense oligonucleotide at the 2', 3', of 5' position of the nucleoside. In certain embodiments, a conjugated antisense compound has the following structure:

A-B-C-D-(-E-F)$_q$ wherein
A is the antisense oligonucleotide;
B is the cleavable moiety
C is the conjugate linker
D is the branching group
each E is a tether;
each F is a ligand; and
q is an integer between 1 and 5.

In certain embodiments, a conjugated antisense compound has the following structure:

A-C-D-(-E-F)$_q$ wherein
A is the antisense oligonucleotide;
C is the conjugate linker
D is the branching group
each E is a tether;
each F is a ligand; and
q is an integer between 1 and 5.

In certain such embodiments, the conjugate linker comprises at least one cleavable bond.

In certain such embodiments, the branching group comprises at least one cleavable bond.

In certain embodiments each tether comprises at least one cleavable bond.

In certain embodiments, the conjugates are bound to a nucleoside of the antisense oligonucleotide at the 2', 3', of 5' position of the nucleoside.

In certain embodiments, a conjugated antisense compound has the following structure:

A-B-C-(-E-F)$_q$ wherein
A is the antisense oligonucleotide;
B is the cleavable moiety
C is the conjugate linker
each E is a tether;
each F is a ligand; and
q is an integer between 1 and 5.

In certain embodiments, the conjugates are bound to a nucleoside of the antisense oligonucleotide at the 2', 3', of 5' position of the nucleoside. In certain embodiments, a conjugated antisense compound has the following structure:

A-C-(-E-F)$_q$ wherein
A is the antisense oligonucleotide;
C is the conjugate linker
each E is a tether;
each F is a ligand; and
q is an integer between 1 and 5.

In certain embodiments, a conjugated antisense compound has the following structure:

A-B-D-(-E-F)$_q$ wherein
A is the antisense oligonucleotide;
B is the cleavable moiety
D is the branching group
each E is a tether;
each F is a ligand; and
q is an integer between 1 and 5.

In certain embodiments, a conjugated antisense compound has the following structure:

A-D-(-E-F)$_q$ wherein
A is the antisense oligonucleotide;
D is the branching group
each E is a tether;
each F is a ligand; and
q is an integer between 1 and 5.

In certain such embodiments, the conjugate linker comprises at least one cleavable bond.

In certain embodiments each tether comprises at least one cleavable bond.

In certain embodiments, a conjugated antisense compound has a structure selected from among the following:

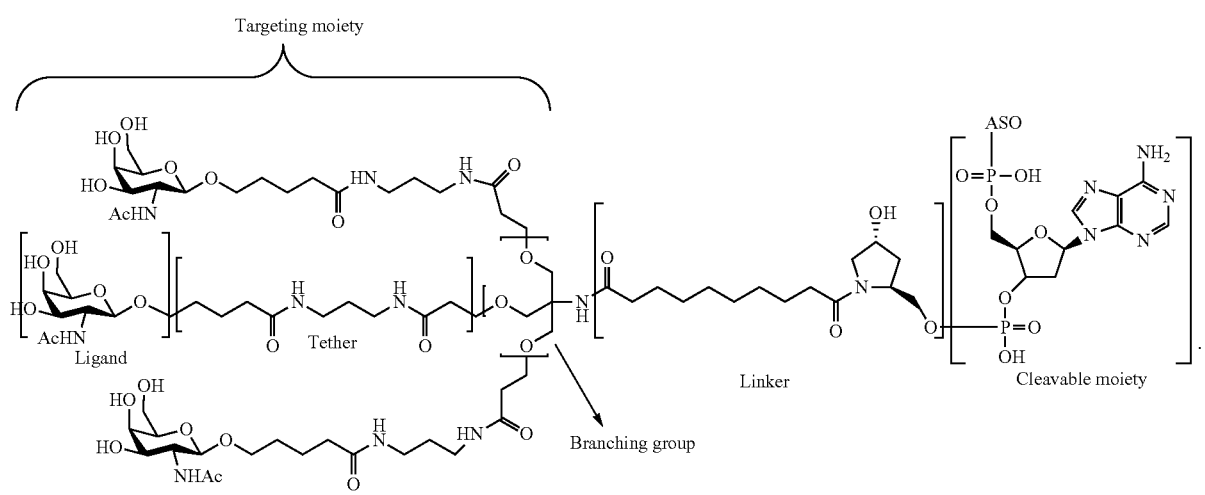

In certain embodiments, a conjugated antisense compound has a structure selected from among the following:
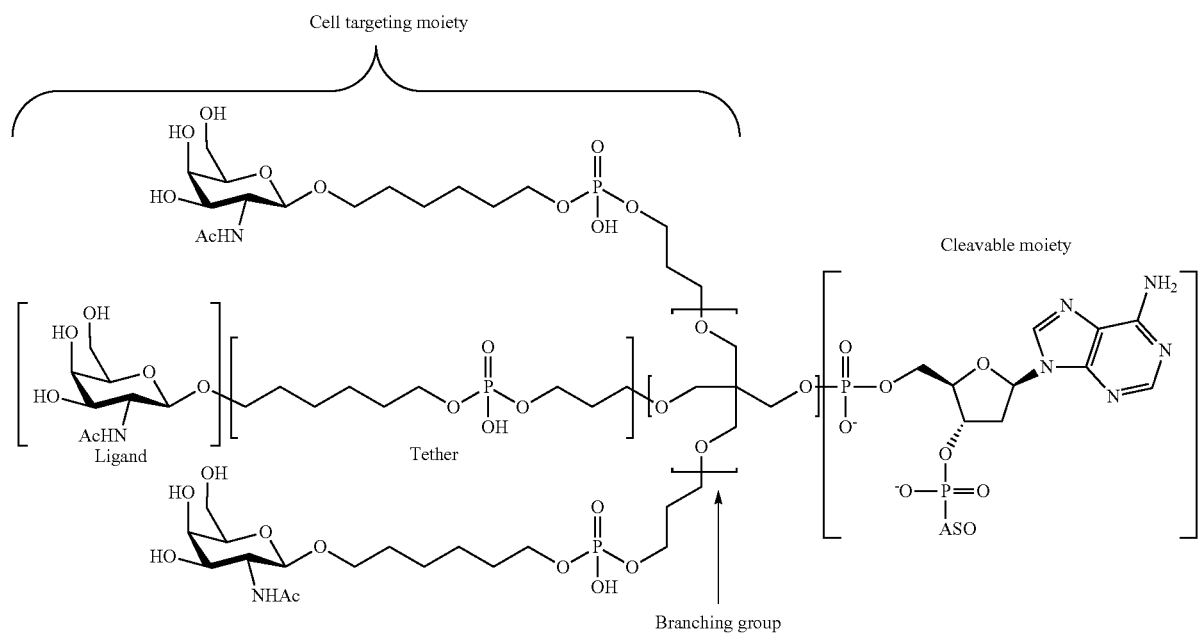
In certain embodiments, a conjugated antisense compound has a structure selected from among the following:
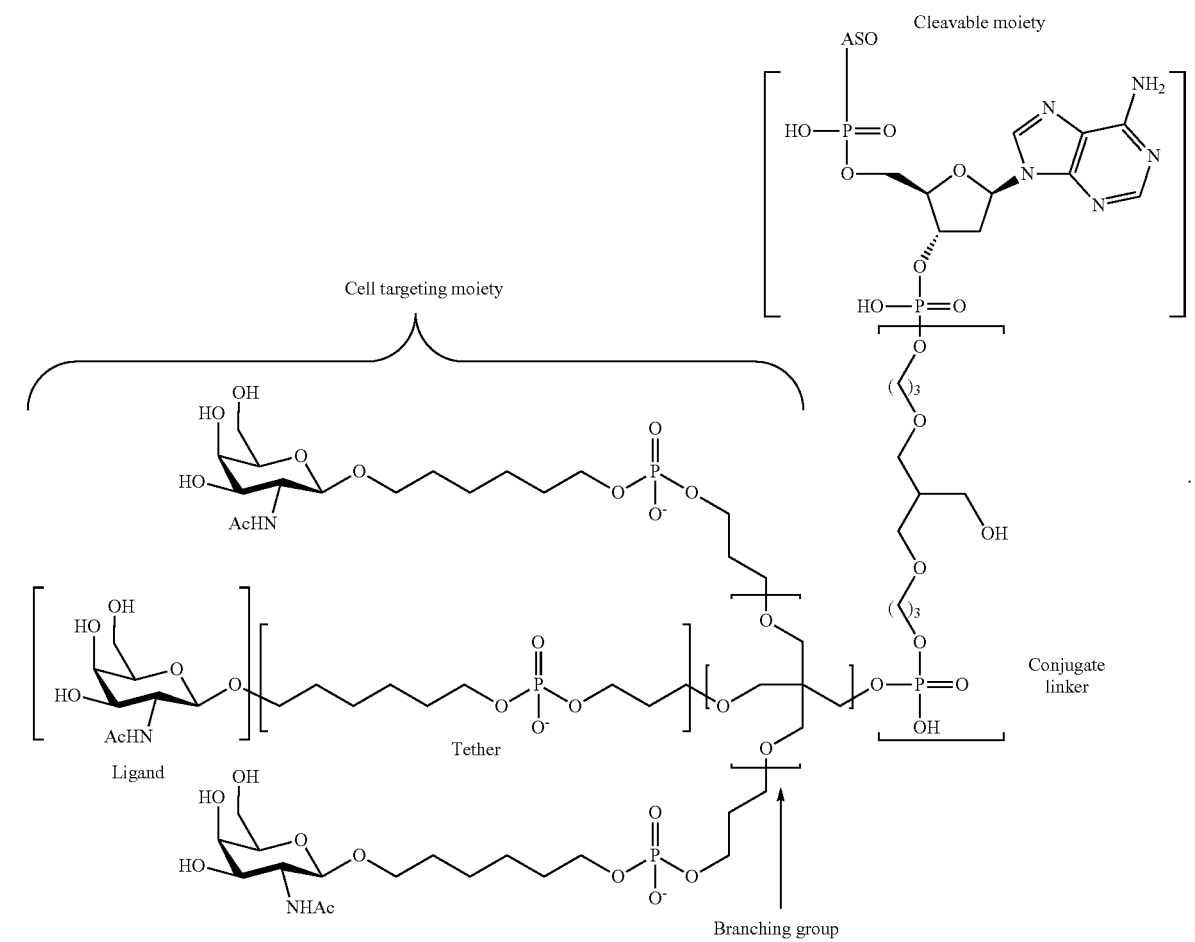

In certain embodiments, the conjugated antisense compound has the following structure:

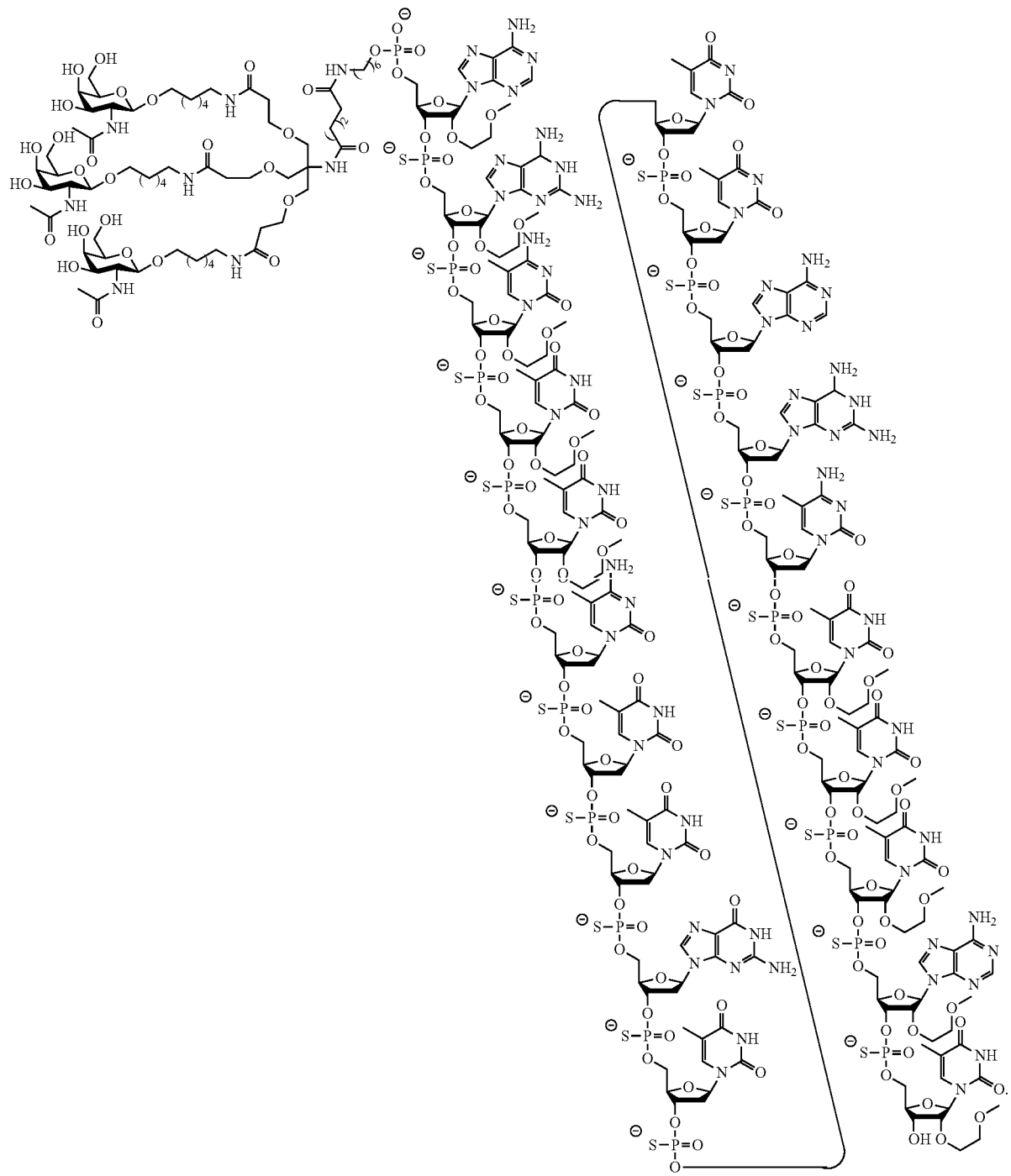

Representative U.S. patents, United States patent application publications, and international patent application publications that teach the preparation of certain of the above noted conjugates, conjugated antisense compounds, tethers, linkers, branching groups, ligands, cleavable moieties as well as other modifications include without limitation, U.S. Pat. No. 5,994,517, U.S. Pat. No. 6,300,319, U.S. Pat. No. 6,660,720, U.S. Pat. No. 6,906,182, U.S. Pat. No. 7,262,177, U.S. Pat. No. 7,491,805, U.S. Pat. No. 8,106,022, U.S. Pat. No. 7,723,509, US 2006/0148740, US 2011/0123520, WO 2013/033230 and WO 2012/037254, each of which is incorporated by reference herein in its entirety.

Representative publications that teach the preparation of certain of the above noted conjugates, conjugated antisense compounds, tethers, linkers, branching groups, ligands, cleavable moieties as well as other modifications include without limitation, BIESSEN et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852, BIESSEN et al., "Synthesis of Cluster Galactosides with High Affinity for the Hepatic Asialoglycoprotein Receptor" J. Med. Chem. (1995) 38:1538-1546, LEE et al., "New and more efficient multivalent glyco-ligands for asialoglycoprotein receptor of mammalian hepatocytes" Bioorganic & Medicinal Chemistry (2011) 19:2494-2500, RENSEN et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584, RENSEN et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808, SLIEDREGT et al., "Design and Synthesis of Novel Amphiphilic Dendritic Galactosides for Selective Targeting of Liposomes to the Hepatic Asialoglycoprotein Receptor" J. Med. Chem. (1999) 42:609-618, and Valentijn et al., "Solid-phase synthesis of lysine-based cluster galactosides with high affinity for the Asialoglycoprotein Receptor" Tetrahedron, 1997, 53(2), 759-770, each of which is incorporated by reference herein in its entirety.

In certain embodiments, conjugated antisense compounds comprise an RNase H based oligonucleotide (such as a gapmer) or a splice modulating oligonucleotide (such as a fully modified oligonucleotide) and any conjugate group comprising at least one, two, or three GalNAc groups. In certain embodiments a conjugated antisense compound comprises any conjugate group found in any of the following references: Lee, Carbohydr Res, 1978, 67, 509-514; Connolly et al., J Biol Chem, 1982, 257, 939-945; Pavia et al., Int J Pep Protein Res, 1983, 22, 539-548; Lee et al., Biochem, 1984, 23, 4255-4261; Lee et al., Glycoconjugate J, 1987, 4, 317-328; Toyokuni et al., Tetrahedron Lett, 1990, 31, 2673-2676; Biessen et al., J Med Chem, 1995, 38, 1538-1546; Valentijn et al., Tetrahedron, 1997, 53, 759-770; Kim et al., Tetrahedron Lett, 1997, 38, 3487-3490; Lee et al., Bioconjug Chem, 1997, 8, 762-765; Kato et al., Glycobiol, 2001, 11, 821-829; Rensen et al., J Biol Chem, 2001, 276, 37577-37584; Lee et al., Methods Enzymol, 2003, 362, 38-43; Westerlind et al., Glycoconj J, 2004, 21, 227-241; Lee et al., Bioorg Med Chem Lett, 2006, 16(19), 5132-5135; Maierhofer et al., Bioorg Med Chem, 2007, 15, 7661-7676; Khorev et al., Bioorg Med Chem, 2008, 16, 5216-5231; Lee et al., Bioorg Med Chem, 2011, 19, 2494-2500; Kornilova et al., Analyt Biochem, 2012, 425, 43-46; Pujol et al., Angew Chemie Int Ed Engl, 2012, 51, 7445-7448; Biessen et al., J Med Chem, 1995, 38, 1846-1852; Sliedregt et al., J Med Chem, 1999, 42, 609-618; Rensen et al., J Med Chem, 2004, 47, 5798-5808; Rensen et al., Arterioscler Thromb Vasc Biol, 2006, 26, 169-175; van Rossenberg et al., Gene Ther, 2004, 11, 457-464; Sato et al., J Am Chem Soc, 2004, 126, 14013-14022; Lee et al., J Org Chem, 2012, 77, 7564-7571; Biessen et al., FASEB J, 2000, 14, 1784-1792; Rajur et al., Bioconjug Chem, 1997, 8, 935-940; Duff et al., Methods Enzymol, 2000, 313, 297-321; Maier et al., Bioconjug Chem, 2003, 14, 18-29; Jayaprakash et al., Org Lett, 2010, 12, 5410-5413; Manoharan, Antisense Nucleic Acid Drug Dev, 2002, 12, 103-128; Merwin et al., Bioconjug Chem, 1994, 5, 612-620; Tomiya et al., Bioorg Med Chem, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132; each of which is incorporated by reference in its entirety.

Cell Culture and Antisense Compounds Treatment

The effects of antisense compounds on the level, activity or expression of ANGPTL3 nucleic acids can be tested in vitro in a variety of cell types. Cell types used for such analyses are available from commercial vendors (e.g. American Type Culture Collection, Manassas, Va.; Zen-Bio, Inc., Research Triangle Park, N.C.; Clonetics Corporation, Walkersville, Md.) and cells are cultured according to the vendor's instructions using commercially available reagents (e.g. Invitrogen Life Technologies, Carlsbad, Calif.). Illustrative cell types include, but are not limited to, HepG2 cells, Hep3B cells, Huh7 (hepatocellular carcinoma) cells, primary hepatocytes, A549 cells, GM04281 fibroblasts and LLC-MK2 cells.

In Vitro Testing of Antisense Oligonucleotides

Described herein are methods for treatment of cells with antisense oligonucleotides, which can be modified appropriately for treatment with other antisense compounds.

In general, cells are treated with antisense oligonucleotides when the cells reach approximately 60-80% confluence in culture.

One reagent commonly used to introduce antisense oligonucleotides into cultured cells includes the cationic lipid transfection reagent LIPOFECTIN® (Invitrogen, Carlsbad, Calif.). Antisense oligonucleotides are mixed with LIPOFECTIN® in OPTI-MEM® 1 (Invitrogen, Carlsbad, Calif.) to achieve the desired final concentration of antisense oligonucleotide and a LIPOFECTIN® concentration that typically ranges 2 to 12 ug/mL per 100 nM antisense oligonucleotide.

Another reagent used to introduce antisense oligonucleotides into cultured cells includes LIPOFECTAMINE 2000® (Invitrogen, Carlsbad, Calif.). Antisense oligonucleotide is mixed with LIPOFECTAMINE 2000® in OPTI-MEM® 1 reduced serum medium (Invitrogen, Carlsbad, Calif.) to achieve the desired concentration of antisense oligonucleotide and a LIPOFECTAMINE® concentration that typically ranges 2 to 12 ug/mL per 100 nM antisense oligonucleotide.

Another reagent used to introduce antisense oligonucleotides into cultured cells includes Cytofectin® (Invitrogen, Carlsbad, Calif.). Antisense oligonucleotide is mixed with Cytofectin® in OPTI-MEM® 1 reduced serum medium (Invitrogen, Carlsbad, Calif.) to achieve the desired concentration of antisense oligonucleotide and a Cytofectin® concentration that typically ranges 2 to 12 ug/mL per 100 nM antisense oligonucleotide.

Another reagent used to introduce antisense oligonucleotides into cultured cells includes Oligofectamine™ (Invitrogen Life Technologies, Carlsbad, Calif.). Antisense oligonucleotide is mixed with Oligofectamine™ in Opti-MEM™-1 reduced serum medium (Invitrogen Life Technologies, Carlsbad, Calif.) to achieve the desired concentration of oligonucleotide with an Oligofectamine™ to oligonucleotide ratio of approximately 0.2 to 0.8 µL per 100 nM.

Another reagent used to introduce antisense oligonucleotides into cultured cells includes FuGENE 6 (Roche Diagnostics Corp., Indianapolis, Ind.). Antisense oligomeric compound was mixed with FuGENE 6 in 1 mL of serum-free RPMI to achieve the desired concentration of oligonucleotide with a FuGENE 6 to oligomeric compound ratio of 1 to 4 µL of FuGENE 6 per 100 nM.

Another technique used to introduce antisense oligonucleotides into cultured cells includes electroporation (Sambrook and Russell, Molecular Cloning: A Laboratory Manual, 3$^{rd}$ Ed., 2001).

Cells are treated with antisense oligonucleotides by routine methods. Cells are typically harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE2000®, Lipofectin or Cytofectin. Antisense oligonucleotides are used at higher concentrations ranging from 625 to 20,000 nM when transfected using electroporation.

RNA Isolation

RNA analysis can be performed on total cellular RNA or poly(A)+ mRNA. Methods of RNA isolation are well known in the art (Sambrook and Russell, Molecular Cloning: A Laboratory Manual, 3$^{rd}$ Ed., 2001). RNA is prepared using methods well known in the art, for example, using the TRIZOL® Reagent (Invitrogen, Carlsbad, Calif.) according to the manufacturer's recommended protocols.

Analysis of Inhibition of Target Levels or Expression

Inhibition of levels or expression of an ANGPTL3 nucleic acid can be assayed in a variety of ways known in the art (Sambrook and Russell, Molecular Cloning: A Laboratory Manual, 3$^{th}$ Ed., 2001). For example, target nucleic acid levels can be quantitated by, e.g., Northern blot analysis, competitive polymerase chain reaction (PCR), or quantitative real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM® 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels can be accomplished by quantitative real-time PCR using the ABI PRISM® 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents are obtained from Invitrogen (Carlsbad, Calif.). RT and real-time-PCR reactions are carried out by methods well known to those skilled in the art.

Gene (or RNA) target quantities obtained by real time PCR can be normalized using either the expression level of a gene whose expression is constant, such as cyclophilin A or GADPH or by quantifying total RNA using RIBOGREEN® (Life Technologies™, Inc. Carlsbad, Calif.). Cyclophilin A or GADPH expression can be quantified by real time PCR, by being run simultaneously with the target, multiplexing, or separately. Total RNA can be quantified using RIBOGREEN® RNA quantification reagent. Methods of RNA quantification by RIBOGREEN® are taught in Jones, L. J., et al, (Analytical Biochemistry, 1998, 265, 368-374). A CYTOFLUOR® 4000 instrument (PE Applied Biosystems) can be used to measure RIBOGREEN® fluorescence.

Methods for designing real-time PCR probes and primers are well known in the art, and can include the use of software such as PRIMER EXPRESS® Software (Applied Biosystems, Foster City, Calif.). Probes and primers used in real-time PCR were designed to hybridize to ANGPTL3 specific sequences and are disclosed in the Examples below. The target specific PCR probes can have FAM covalently linked to the 5' end and TAMRA or MGB covalently linked to the 3' end, where FAM is the fluorescent dye and TAMRA or MGB is the quencher dye.

Analysis of Protein Levels

Antisense inhibition of ANGPTL3 nucleic acids can be assessed by measuring ANGPTL3 protein levels. Protein levels of ANGPTL3 can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS) (Sambrook and Russell, Molecular Cloning: A Laboratory Manual, 3$^{th}$ Ed., 2001). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

In Vivo Testing of Antisense Compounds

Antisense compounds, for example, antisense oligonucleotides, are tested in animals to assess their ability to inhibit expression of ANGPTL3 and produce phenotypic changes. Testing can be performed in normal animals, or in experimental disease models. For administration to animals, antisense oligonucleotides are formulated in a pharmaceutically acceptable diluent, such as phosphate-buffered saline. Administration includes parenteral routes of administration. Following a period of treatment with antisense oligonucleotides, RNA is isolated from tissue and changes in ANGPTL3 nucleic acid expression are measured. Changes in ANGPTL3 protein levels are also measured.

Certain Indications

In certain embodiments, provided herein are methods of treating an individual comprising administering one or more pharmaceutical compositions as described herein. In certain embodiments, the individual has a metabolic disease and/or cardiovascular disease. In certain embodiments, the individual has combined hyperlipidemia (e.g., familial or non-familial), hypercholesterolemia (e.g., familial homozygous hypercholesterolemia (HoFH), familial heterozygous hypercholesterolemia (HeFH)), dyslipidemia, lipodystrophy, hypertriglyceridemia (e.g., heterozygous LPL deficiency, homozygous LPL deficiency), coronary artery disease (CAD), familial chylomicronemia syndrome (FCS), hyperlipoproteinemia Type IV), metabolic syndrome, non-alcoholic fatty liver disease (NAFLD), nonalcoholic steatohepatitis (NASH), diabetes (e.g., Type 2 diabetes, Type 2 diabetes with dyslipidemia), insulin resistance (e.g., insulin resistance with dyslipidemia), vascular wall thickening, high blood pressure (e.g., pulmonary arterial hypertension), sclerosis (e.g., atherosclerosis, systemic sclerosis, progressive skin sclerosis and proliferative obliterative vasculopathy such as digital ulcers and pulmonary vascular involvement), or a combination thereof.

In certain embodiments, the compounds targeted to ANGPTL3 described herein modulate lipid and/or energy metabolism in an animal. In certain embodiments, the compounds targeted to ANGPTL3 described herein modulate physiological markers or phenotypes of hypercholesterolemia, dyslipidemia, lipodystrophy, hypertriglyceridemia, metabolic syndrome, NAFLD, NASH and/or diabetes. For example, administration of the compounds to animals can modulate one or more of VLDL, non-esterified fatty acids (NEFA), LDL, cholesterol, triglyceride, glucose, insulin or ANGPTL3 levels. In certain embodiments, the modulation of the physiological markers or phenotypes can be associated with inhibition of ANGPTL3 by the compounds.

In certain embodiments, the compounds targeted to ANGPTL3 described herein reduce and/or prevent one or more of hepatic TG accumulation (i.e. hepatic steatosis), atherosclerosis, vascular wall thickening (e.g., arterial intima-media thickening), combined hyperlipidemia (e.g., familial or non-familial), hypercholesterolemia (e.g., familial homozygous hypercholesterolemia (HoFH), familial heterozygous hypercholesterolemia (HeFH)), dyslipidemia, lipodystrophy, hypertriglyceridemia (e.g., heterozygous LPL deficiency, homozygous LPL deficiency, familial chylomicronemia syndrome (FCS), hyperlipoproteinemia Type IV), metabolic syndrome, non-alcoholic fatty liver disease (NAFLD), nonalcoholic steatohepatitis (NASH), diabetes (e.g., Type 2 diabetes, Type 2 diabetes with dyslipidemia), insulin resistance (e.g., insulin resistance with dyslipidemia), high blood pressure and sclerosis, or any combination thereof. In certain embodiments, the compounds targeted to ANGPTL3 described herein improve insulin sensitivity.

In certain embodiments, administration of an antisense compound targeted to an ANGPTL3 nucleic acid results in reduction of ANGPTL3 expression by about at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 99%, or a range defined by any two of these values.

In certain embodiments, pharmaceutical compositions comprising an antisense compound targeted to ANGPTL3 are used for the preparation of a medicament for treating a patient suffering from, or susceptible to, a metabolic disease or cardiovascular disease. In certain embodiments, pharmaceutical compositions comprising an antisense compound targeted to ANGPTL3 are used in the preparation of a medicament for treating a patient suffering from, or susceptible to, one or more of combined hyperlipidemia (e.g., familial or non-familial), hypercholesterolemia (e.g., familial homozygous hypercholesterolemia (HoFH), familial heterozygous hypercholesterolemia (HeFH)), dyslipidemia, lipodystrophy, hypertriglyceridemia (e.g., familial chylomicronemia syndrome (FCS), hyperlipoproteinemia Type IV), metabolic syndrome, non-alcoholic fatty liver disease (NAFLD), non-alcoholic steatohepatitis (NASH), diabetes (e.g., Type 2 diabetes, Type 2 diabetes with dyslipidemia), insulin resistance (e.g., insulin resistance with dyslipidemia), vascular wall thickening, high blood pressure and sclerosis, or a combination thereof.

Administration

In certain embodiments, the compounds and compositions as described herein are administered parenterally.

In certain embodiments, parenteral administration is by infusion. Infusion can be chronic or continuous or short or intermittent. In certain embodiments, infused pharmaceutical agents are delivered with a pump.

In certain embodiments, parenteral administration is by injection. The injection can be delivered with a syringe or a pump. In certain embodiments, the injection is a bolus injection. In certain embodiments, the injection is administered directly to a tissue or organ. In certain embodiments, the injection is subcutaneous.

Certain Combination Therapies

In certain embodiments, a first agent comprising the modified oligonucleotide disclosed herein is co-administered with one or more secondary agents. In certain embodiments, such second agents are designed to treat the same disease, disorder or condition as the first agent described herein. In certain embodiments, such second agents are designed to treat a different disease, disorder, or condition as the first agent described herein. In certain embodiments, such second agents are designed to treat an undesired side effect of one or more pharmaceutical compositions as described herein. In certain embodiments, second agents are co-administered with the first agent to treat an undesired effect of the first agent. In certain embodiments, second agents are co-administered with the first agent to produce a combinational effect. In certain embodiments, second agents are co-administered with the first agent to produce a synergistic effect.

In certain embodiments, a first agent and one or more second agents are administered at the same time. In certain embodiments, the first agent and one or more second agents are administered at different times. In certain embodiments, the first agent and one or more second agents are prepared together in a single pharmaceutical formulation. In certain embodiments, the first agent and one or more second agents are prepared separately.

In certain embodiments, second agents include, but are not limited to a glucose-lowering agent or a lipid-lowering agent. The glucose lowering agent can include, but is not limited to, a therapeutic lifestyle change, PPAR agonist, a dipeptidyl peptidase (IV) inhibitor, a GLP-1 analog, insulin or an insulin analog, an insulin secretagogue, a SGLT2 inhibitor, a human amylin analog, a biguanide, an alpha-glucosidase inhibitor, or a combination thereof. The glucose-lowering agent can include, but is not limited to metformin, sulfonylurea, rosiglitazone, meglitinide, thiazolidinedione, alpha-glucosidase inhibitor or a combination thereof. The sulfonylurea can be acetohexamide, chlorpropamide, tolbutamide, tolazamide, glimepiride, a glipizide, a glyburide, or a gliclazide. The meglitinide can be nateglinide or repaglinide. The thiazolidinedione can be pioglitazone or rosiglitazone. The alpha-glucosidase can be acarbose or miglitol. In certain embodiments the lipid lowering therapy can include, but is not limited to, a therapeutic lifestyle change, niacin, HMG-CoA reductase inhibitor, cholesterol absorption inhibitor, MTP inhibitor (e.g., a small molecule, polypeptide, antibody or antisense compound targeted to MTP), fibrate, PCSK9 inhibitor (e.g., PCSK9 antibodies, polypeptides, small molecules nucleic acid compounds targeting PCSK9), CETP inhibitor (e.g., small molecules such as torcetrapib and anacetrapib, polypeptides, antibodies or nucleic acid compounds targeted to CETP), apoC-III inhibitor (e.g., a small molecule, polypeptide, antibody or nucleic acid compounds targeted to apoC-III), apoB inhibitor (e.g., a small molecule, polypeptide, antibody or nucleic acid compounds targeted to apoB), beneficial oils rich in omega-3 fatty acids, omega-3 fatty acids or any combination thereof. The HMG-CoA reductase inhibitor can be atorvastatin, rosuvastatin, fluvastatin, lovastatin, pravastatin, simvastatin and the like. The cholesterol absorption inhibitor can be ezetimibe. The fibrate can be fenofibrate, bezafibrate, ciprofibrate, clofibrate, gemfibrozil and the like. The beneficial oil rich in omega-3 fatty acids can be krill, fish (e.g., Vascepa$^R$), flaxseed oil and the like. The omega-3 fatty acid can be ALA, DHA, EPA and the like.

Certain Compounds

Antisense oligonucleotides targeting human ANGPTL3 were described in an earlier publication (see PCT Patent Publication No. WO 2011/085271 published Jul. 14, 2011, incorporated by reference herein, in its entirety). Several oligonucleotides (233676, 233690, 233710, 233717, 233721, 233722, 337459, 337460, 337474, 337477, 337478, 337479, 337481, 337484, 337487, 337488, 337490, 337491, 337492, 337497, 337498, 337503, 337505, 337506, 337508, 337513, 337514, 337516, 337520, 337521, 337525, 337526 and 337528) described therein, including the top ten most potent antisense compounds in vitro, were used as benchmarks throughout select in vitro screens for antisense compounds described hereinbelow and in U.S. Ser. No. 61/920,652. Of the most potent compounds described in WO 2011/085271, ISIS 233722 was found to be highly variable in its ability to inhibit ANGPTL3. According, although initially included in some in vitro studies, 233722 was not selected as a benchmark for further studies. Of the previously identified potent in vitro benchmark compounds, five (233710, 233717, 337477, 337478, 337479 and 337487) were selected for testing in vivo, as described hereinbelow, in huANGPTL3 transgenic mice to assess the most potent in reducing human mRNA transcript and protein expression (Example 126). The antisense oligonucleotide with the highest initial in vivo potency in reducing ANGPTL3 levels (233710) was used as a benchmark for in vivo assessment of the new antisense compounds described hereinbelow.

In certain embodiments, the antisense compounds described herein benefit from one or more improved properties relative to the antisense compounds described in WO 2011/085271 and in U.S. Ser. No. 61/920,652. These improved properties are demonstrated in the examples herein, and a non-exhaustive summary of the examples is provided below for ease of reference.

In a first screen described herein, about 3000 newly designed 5-10-5 MOE gapmer antisense compounds targeting human ANGPTL3 were tested in Hep3B cells for their effect on human ANGPTL3 mRNA in vitro (Example 116). The mRNA inhibition levels of the new antisense compounds were assessed with some previously designed antisense compounds (233717, 337484, 337487, 337492 and 337516) used as benchmarks in select studies. Of the about 3000 newly designed antisense compounds from this first screen, about 85 antisense compounds were selected for in vitro dose-dependent inhibition studies to determine their half maximal inhibitory concentration (IC$_{50}$) (Examples 117-118). Of the about 85 new antisense compounds tested for their half maximal inhibitory concentration (IC$_{50}$), about 38 antisense compounds that demonstrated potent dose-dependent reduction of ANGPTL3 were selected for in vivo potency and tolerability (ALT and AST) testing in mice (Examples 126-127) with antisense compound 233710 used as a benchmark.

In a second screen described herein, about 2000 newly designed antisense compounds targeting human ANGPTL3 with a MOE gapmer motif or a mixed motif (deoxy, 5-10-5 MOE and cET gapmers) were also tested in Hep3B cells for their effect on human ANGPTL3 mRNA in vitro (Examples 119-121). The inhibition levels of the new antisense compounds were assessed with some previously designed antisense compounds (233717, 337487, 337513, 337514 and 337516) used as benchmarks in select studies. Of the about 2000 newly designed antisense compounds from this second screen, about 147 antisense compounds were selected for in vitro dose-dependent inhibition studies to determine their half maximal inhibitory concentration (IC$_{50}$) (Examples 122-125). Of the about 147 new antisense compounds from tested for their half maximal inhibitory concentration (IC$_{50}$), about 73 antisense compounds that demonstrated potent dose-dependent reduction of ANGPTL3 were selected for in vivo potency and tolerability (e.g., ALT and AST) testing in mice (Examples 126-127) with antisense compound 233710 used as a benchmark.

Of the about 111 antisense compounds from screens one and two that were tested for potency and tolerability in mice, 24 were selected for more extensive tolerability testing in mice by assessing liver metabolic markers, such as alanine transaminase (ALT), aspartate transaminase (AST), albumin and bilirubin, as well as kidney metabolic markers BUN and creatinine and organ weight (Example 127).

In parallel with the in vivo murine studies seventeen antisense compounds were selected for viscosity testing (Example 128). Generally, antisense compounds that were not optimal for viscosity were not taken forward in further studies.

Based on the results of the mice tolerability study, twenty antisense compounds were selected for in vivo tolerability testing in rats (Example 129). In the rats, liver metabolic markers, such as ALT, AST, albumin and bilirubin, body and organ weights, as well as kidney metabolic markers, such as BUN, creatinine and total protein/creatinine ratio, were measured to determine the tolerability of a compound in vivo.

The twenty antisense compounds tested in the rats were also assessed for cross-reactivity to a rhesus monkey ANGPTL3 gene sequence (Example 130). Although the antisense compounds in this study were tested in cynomolgus monkeys, the cynomolgus monkey ANGPTL3 sequence was not available for comparison to the sequences of the full-length compounds, therefore the sequences of the antisense compounds were compared to that of the closely related rhesus monkey. The sequences of eight antisense compounds were found to have 0-2 mismatches with the rhesus ANGPTL3 gene sequence and were further studied in cynomolgus monkeys (Example 130). The eight antisense compounds (ISIS 563580, ISIS 560400, ISIS 567320, ISIS 567321, ISIS 544199, ISIS 567233, ISIS 561011 and ISIS 559277) were tested for inhibition of ANGPTL3 mRNA and protein expression as well as tolerability in the monkeys. In the tolerability studies, body weights, liver metabolic markers (ALT, AST and bilirubin), kidney metabolic markers (BUN and creatinine), hematology parameters (blood cell counts, hemoglobin and hematocrit), and pro-inflammatory markers (CRP and C3) were measured. Additionally, the full-length oligonucleotide concentration present in liver and kidney was measured and the ratio of full-length oligonucleotide in the kidney/liver was calculated.

The sequence of a potent and tolerable antisense compound, ISIS 563580, assessed in cynomolgus monkeys was further modified with a GalNAc conjugate and/or changes in the backbone chemistry as shown in Examples 113-115 and 131 and evaluated for increase potency.

Accordingly, provided herein are antisense compounds with any one or more improved characteristics e.g., improved relative to the antisense compounds described in WO 2011/085271 and in U.S. Ser. No. 61/920,652. In certain embodiments, provided herein are antisense compounds comprising a modified oligonucleotide as described herein targeted to, or specifically hybridizable with, a region of nucleotides of any one of SEQ ID NOs: 1-2.

In certain embodiments, certain antisense compounds as described herein are efficacious by virtue of their potency in inhibiting ANGPTL3 expression. In certain embodiments, the compounds or compositions inhibit ANGPTL3 by at least 40%, at least 45%, at least 50%, at least 55%, at least 60%, at least 65%, at least 70%, at least 75%, at least 80%, at least 85%, at least 90% or at least 95%.

In certain embodiments, certain antisense compounds as described herein are efficacious by virtue of an in vitro $IC_{50}$ of less than 20 µM, less than 10 µM, less than 8 µM, less than 5 µM, less than 2 µM, less than 1 µM, less than 0.9 µM, less than 0.8 µM, less than 0.7 µM, less than 0.6 µM, or less than 0.5 µM when tested in human cells, for example, in the Hep3B cell line (as described in Examples 117-118 and 122-125). In certain embodiments, preferred antisense compounds having an $IC_{50}$<1.0 µM include SEQ ID NOs: 15, 20, 24, 34, 35, 36, 37, 42, 43, 44, 47, 50, 51, 57, 58, 60, 77, 79, 82, 87, 88, 90, 91, 93, 94, 100, 101, 104, 110, 111, 112, 113, 114, 115, 116, 117, 118, 119, 120, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 169, 170, 177, 188, 209, 210, 211, 212, 213, 214, 215, 216, 217, 218, 219, 220, 221, 222, 223, 224, 225, 226, 227, 228, 229, 230, 231, and 232. In certain embodiments, preferred antisense compounds having an $IC_{50}$<0.9 µM include SEQ ID NOs: 15, 20, 35, 36, 42, 43, 44, 50, 57, 60, 77, 79, 87, 88, 90, 91, 93, 94, 101, 104, 110, 111, 112, 113, 114, 115, 116, 117, 118, 119, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 177, 209, 210, 211, 212, 213, 214, 215, 216, 217, 218, 219, 220, 221, 222, 223, 224, 225, 226, 227, 228, 229, 230, 231, and 232. In certain embodiments, preferred antisense compounds having an $IC_{50}$<0.8 µM include SEQ ID NOs: 15, 20, 35, 36, 42, 43, 44, 50, 57, 60, 77, 79, 87, 88, 90, 91, 93, 94, 101, 104, 110, 111, 112, 113, 114, 115, 116, 117, 118, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 177, 209, 210, 211, 212, 213, 214, 215, 217, 218, 219, 220, 221, 222, 223, 224, 225, 228, 229, 230, 231, and 232. In certain embodiments, preferred antisense compounds having an $IC_{50}$<0.7 µM include SEQ ID NOs: 15, 20, 36, 42, 43, 57, 60, 114, 117, 127, 131, 177, 209, 210, 211, 212, 213, 214, 215, 217, 218, 219, 220, 221, 222, 223, 224, 225, 228, 229, 230, 231, and 232. In certain embodiments, preferred antisense compounds having an $IC_{50}$<0.6 µM include SEQ ID NOs: 15, 20, 36, 42, 43, 57, 60, 114, 117, 127, 131, 177, 209, 210, 211, 212, 213, 215, 217, 218, 219, 220, 221, 222, 224, 225, 228, 229, 230, 231, and 232. In certain embodiments, preferred antisense compounds having an $IC_{50}$<0.5 µM include SEQ ID NOs: 43, 114, 117, 127, 131, 177, 209, 210, 211, 212, 215, 217, 218, 219, 220, 221, 222, 229, 230, and 232.

In certain embodiments, certain antisense compounds as described herein are efficacious by virtue of having a viscosity of less than 40 cP, less than 35 cP, less than 30 cP, less than 25 cP, less than 20 cP, less than 15 cP, or less than 10 cP when measured by an assay (as described in Example 128). Oligonucleotides having a viscosity greater than 40 cP would have less than optimal viscosity. In certain embodiments, preferred antisense compounds having a viscosity <20 cP include SEQ ID NOs: 16, 18, 20, 34, 35, 36, 38, 49, 77, 90, 93, and 94. In certain embodiments, preferred antisense compounds having a viscosity <15 cP include SEQ ID NOs: 16, 18, 20, 34, 35, 38, 49, 90, 93, and 94. In certain embodiments, preferred antisense compounds having a viscosity <10 cP include SEQ ID NOs: 18, 34, 35, 49, 90, 93, and 94.

In certain embodiments, certain antisense compounds as described herein are highly tolerable, as demonstrated by the in vivo tolerability measurements described in the examples. In certain embodiments, the certain antisense compounds as described herein are highly tolerable, as demonstrated by having an increase in ALT and/or AST value of no more than 3 fold, 2 fold or 1.5 fold over saline treated animals.

In certain embodiments, certain antisense compounds as described herein are efficacious by virtue of having one or more of an inhibition potency of greater than 50%, an in vitro $IC_{50}$ of less than 1 µM, a viscosity of less than 20 cP, and no more than a 3 fold increase in ALT and/or AST.

In certain embodiments, ISIS 563580 (SEQ ID NO: 77) is preferred. This compound was found to be a potent inhibitor in ANGPTL3 transgenic mice and the most tolerable antisense compound. It had an acceptable viscosity of about 16.83 cP and an $IC_{50}$ value of <0.8 µM in vitro. In mice it had no more than a 3 fold increase in ALT and/or AST levels over saline treated animals. Also, in monkeys, it was among the most tolerable and potent compounds in inhibiting ANGPTL3 and had the best ratio of full-length oligonucleotide concentration.

In certain embodiments, ISIS 544199 (SEQ ID NO: 20) is preferred. This compound was found to be a potent and tolerable antisense compound. It had an acceptable viscosity of 1.7 cP and an $IC_{50}$ value of <0.5 µM in vitro. In mice it had no more than a 3 fold increase in ALT and/or AST levels over saline treated animals. Also, in monkeys, it was among the most potent compounds in inhibiting ANGPTL3 and had a good ratio of full-length oligonucleotide concentration.

In certain embodiments, ISIS 559277 (SEQ ID NO: 110) is preferred. This compound was found to be a potent and tolerable antisense compound. It had an $IC_{50}$ value of <0.8 µM in vitro. In mice it had no more than a 3 fold increase in ALT and/or AST levels over saline treated animals. Also, in monkeys, it was among the most potent compounds in inhibiting ANGPTL3 and had a good ratio of full-length oligonucleotide concentration.

In certain embodiments, a GalNAc conjugated antisense compound, ISIS 658501 (SEQ ID NO: 4912), is preferred. This antisense compound was found to be more potent than its parent compound ISIS 563580 (SEQ ID NO: 77) as shown by the inhibition levels.

In certain embodiments, a GalNAc conjugated antisense compound, ISIS 703801 (SEQ ID NO: 77), is preferred. This antisense compound was found to be several fold more potent than its parent compound ISIS 563580 (SEQ ID NO: 77). ISIS 703801 had an ID50 value of 1 while ISIS 563580 had an ID50 value of 6.

In certain embodiments, a GalNAc conjugated antisense compound, ISIS 703802 (SEQ ID NO: 77), is preferred. This antisense compound was found to be several fold more potent than its parent compound ISIS 563580 (SEQ ID NO: 77). ISIS 703802 had an ID50 value of 0.3 while ISIS 563580 had an ID50 value of 6.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif And, for example, where a particular high-affinity modification appears at a particular position, other high-affinity modifications at the same position are considered suitable, unless otherwise indicated.

Example 1

General Method for the Preparation of Phosphoramidites, Compounds 1, 1a and 2

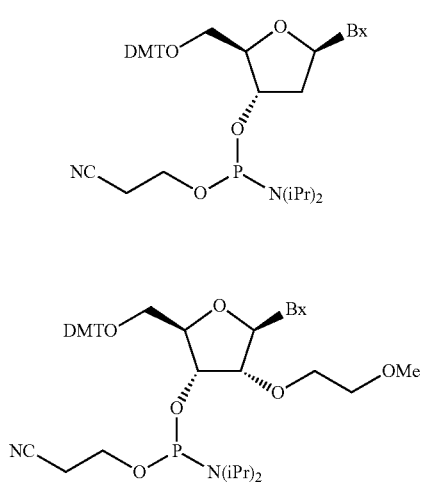

Bx is a heterocyclic base;

Compounds 1, 1a and 2 were prepared as per the procedures well known in the art as described in the specification herein (see Seth et al., Bioorg. Med. Chem., 2011, 21(4), 1122-1125, J. Org. Chem., 2010, 75(5), 1569-1581, Nucleic Acids Symposium Series, 2008, 52(1), 553-554); and also see published PCT International Applications (WO 2011/115818, WO 2010/077578, WO2010/036698, WO2009/143369, WO 2009/006478, and WO 2007/090071), and U.S. Pat. No. 7,569,686).

Example 2

Preparation of Compound 7

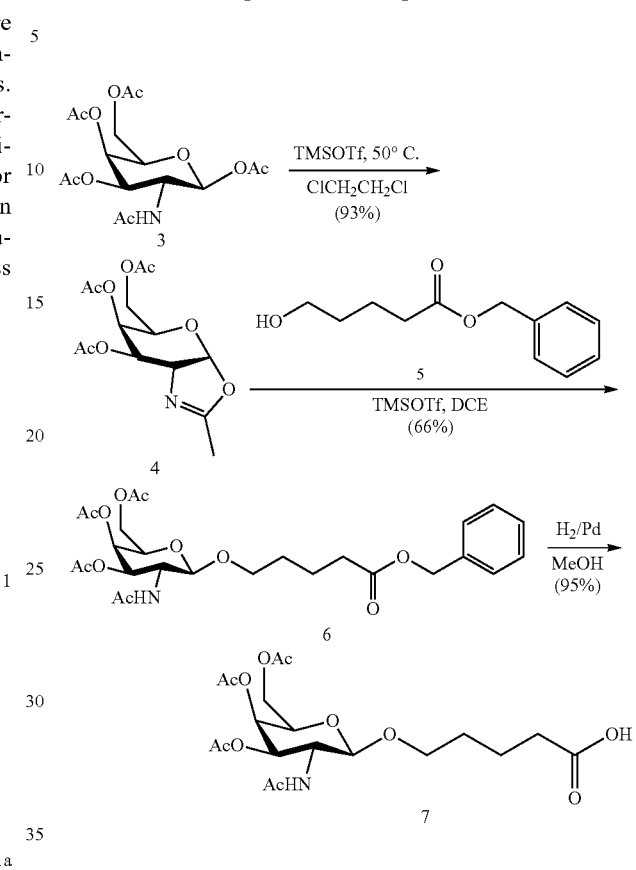

Compounds 3 (2-acetamido-1,3,4,6-tetra-O-acetyl-2-deoxy-β-Dgalactopyranose or galactosamine pentaacetate) is commercially available. Compound 5 was prepared according to published procedures (Weber et al., J. Med. Chem., 1991, 34, 2692).

Example 3

Preparation of Compound 11

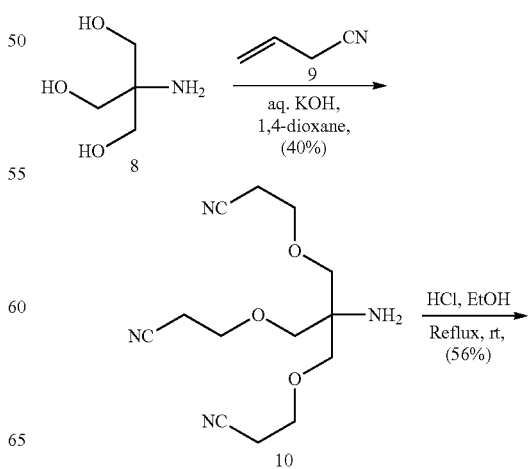

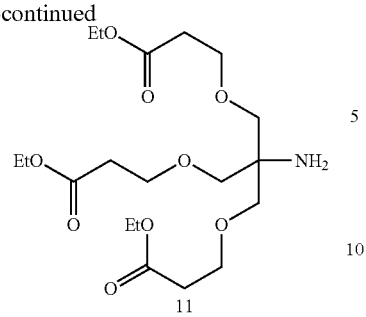
Compounds 8 and 9 are commercially available.
Example 4
Preparation of Compound 18
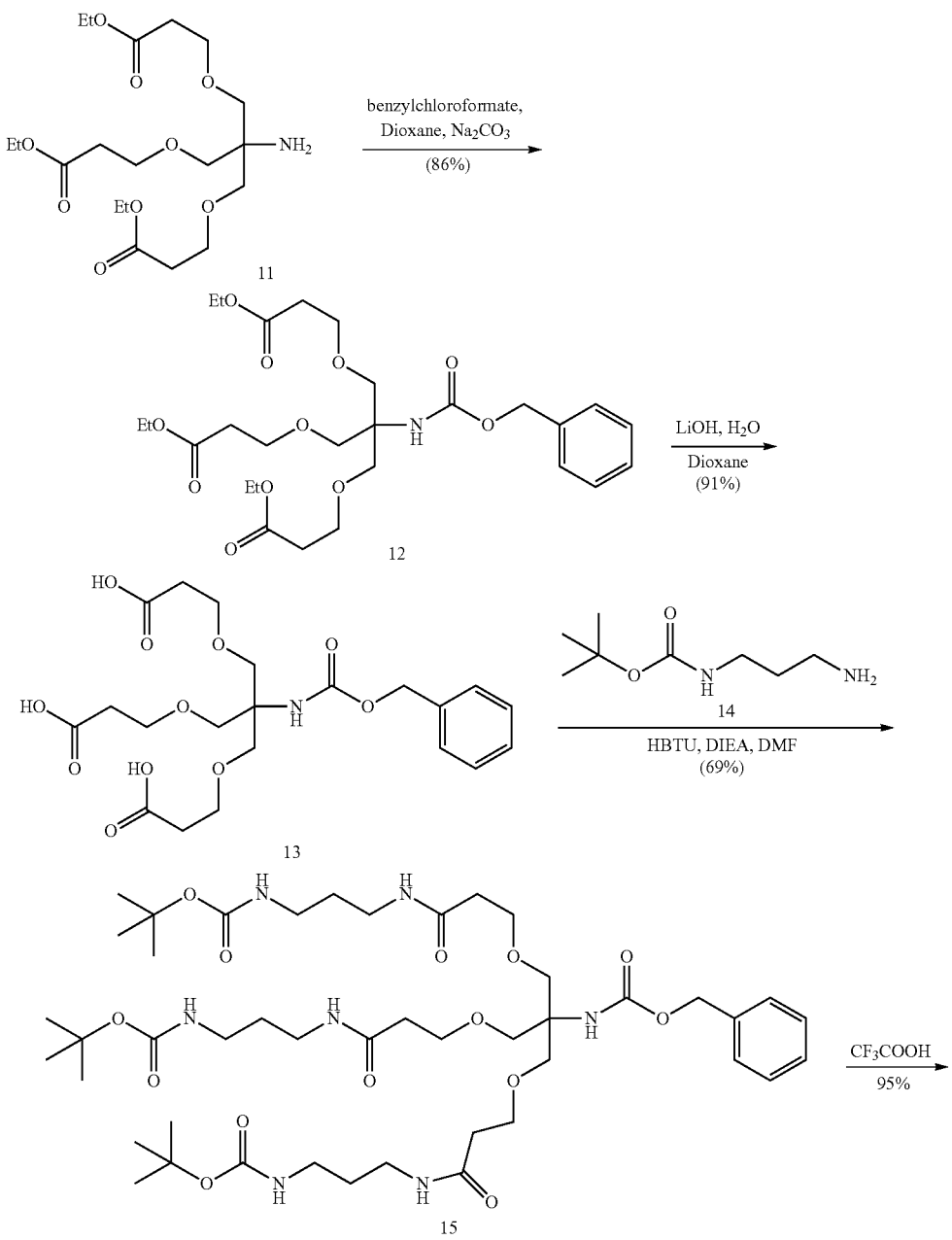

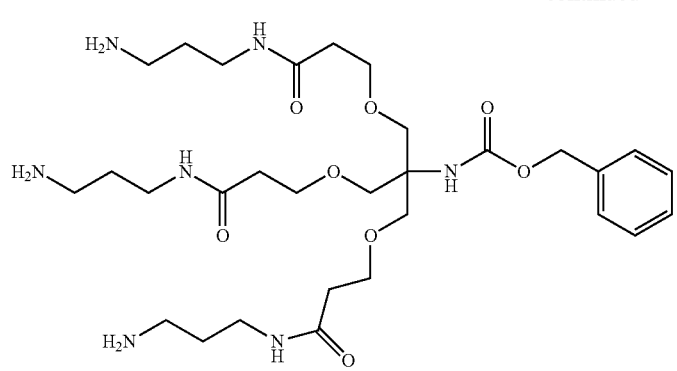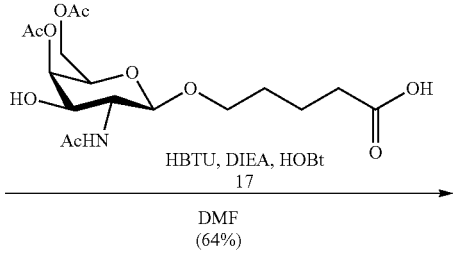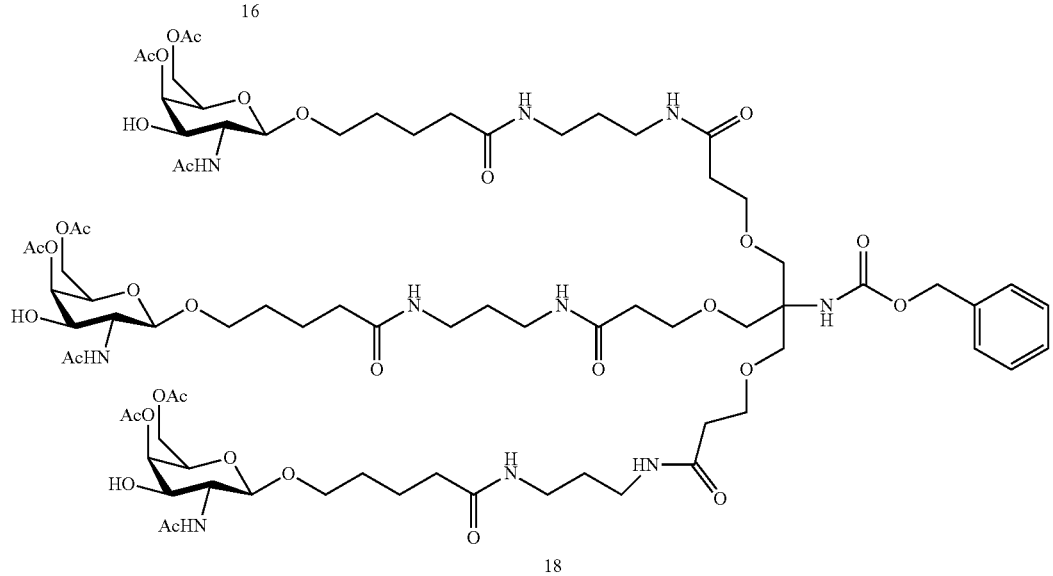
Compound 11 was prepared as per the procedures illustrated in Example 3. Compound 14 is commercially available. Compound 17 was prepared using similar procedures reported by Rensen et al., *J. Med. Chem.*, 2004, 47, 5798-5808.
Example 5
Preparation of Compound 23
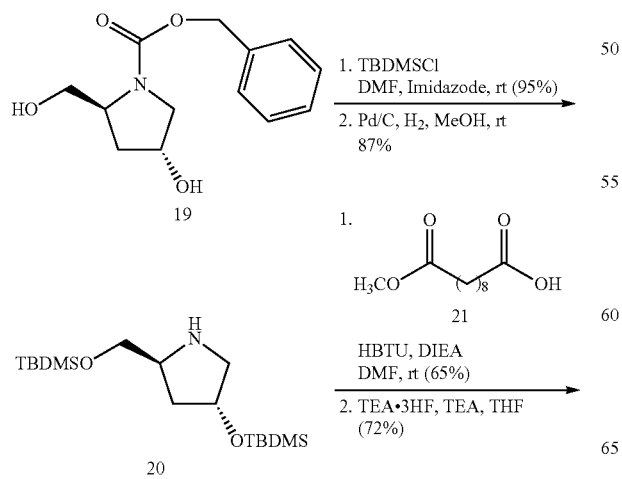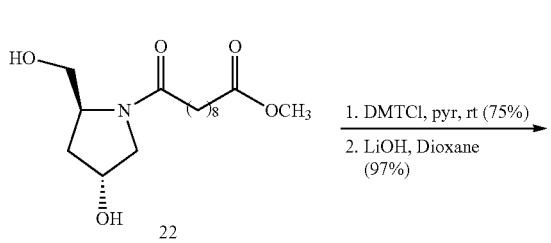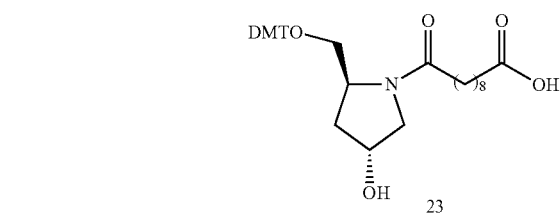
Compounds 19 and 21 are commercially available.

Example 6
Preparation of Compound 24
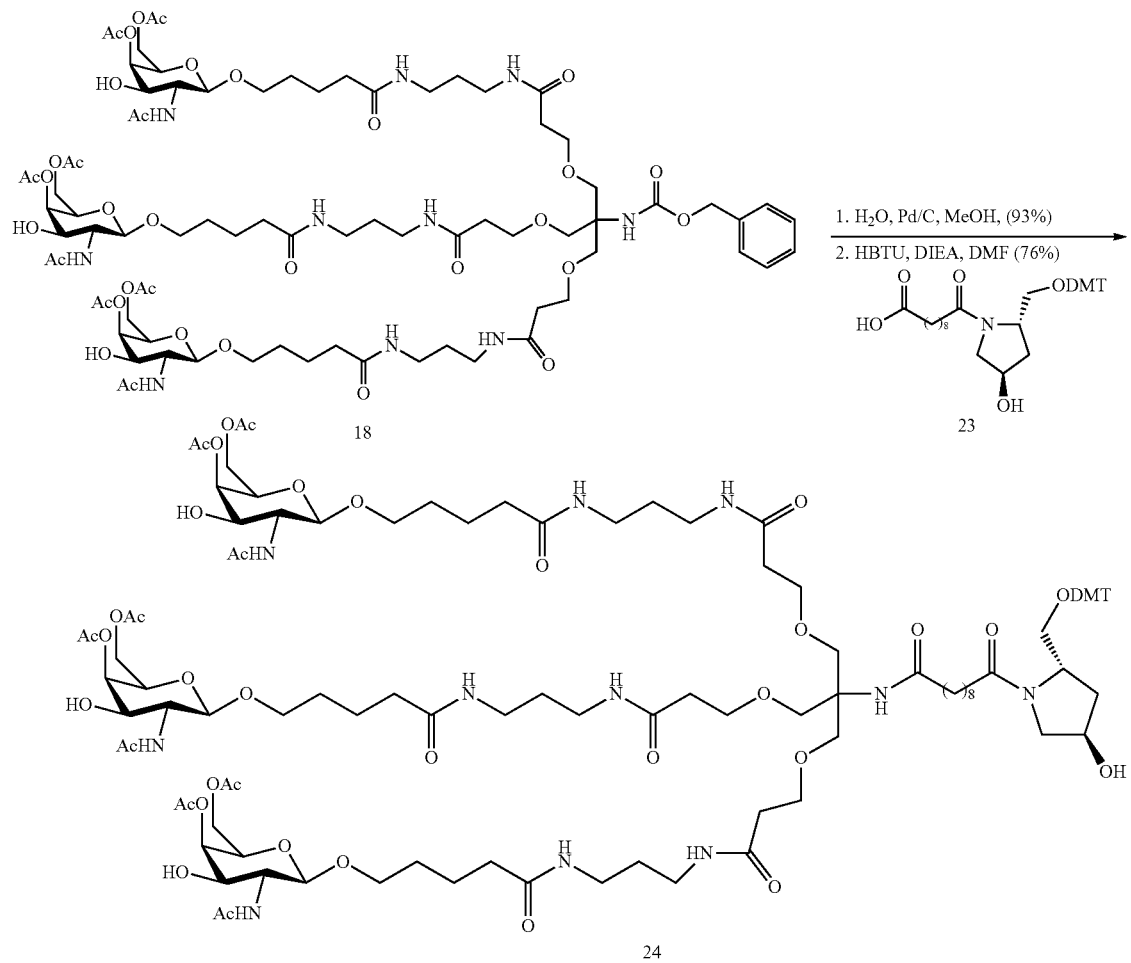
Compounds 18 and 23 were prepared as per the procedures illustrated in Examples 4 and 5.
Example 7
Preparation of Compound 25
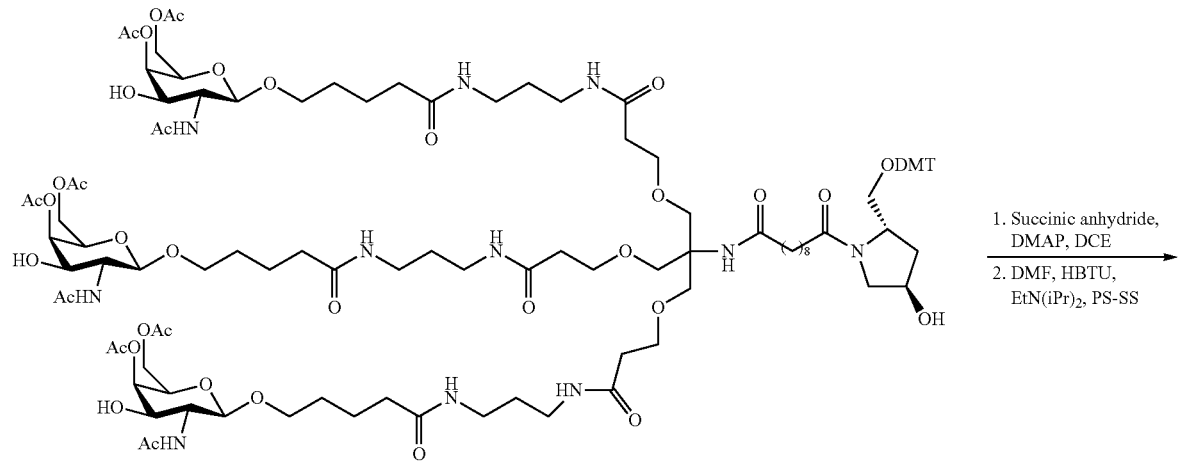

-continued
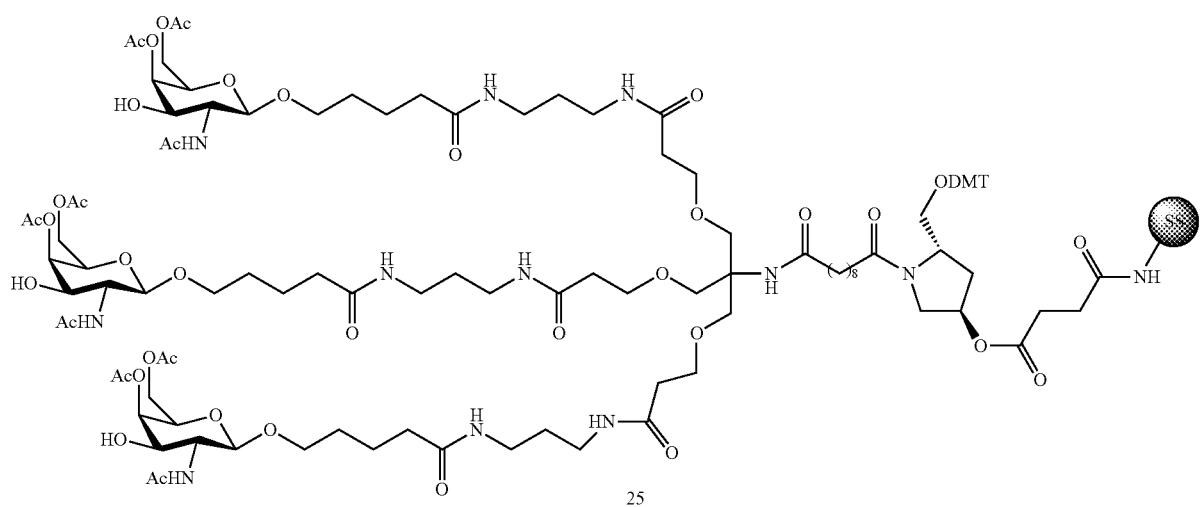
25
Compound 24 was prepared as per the procedures illustrated in Example 6.
Example 8
Preparation of Compound 26
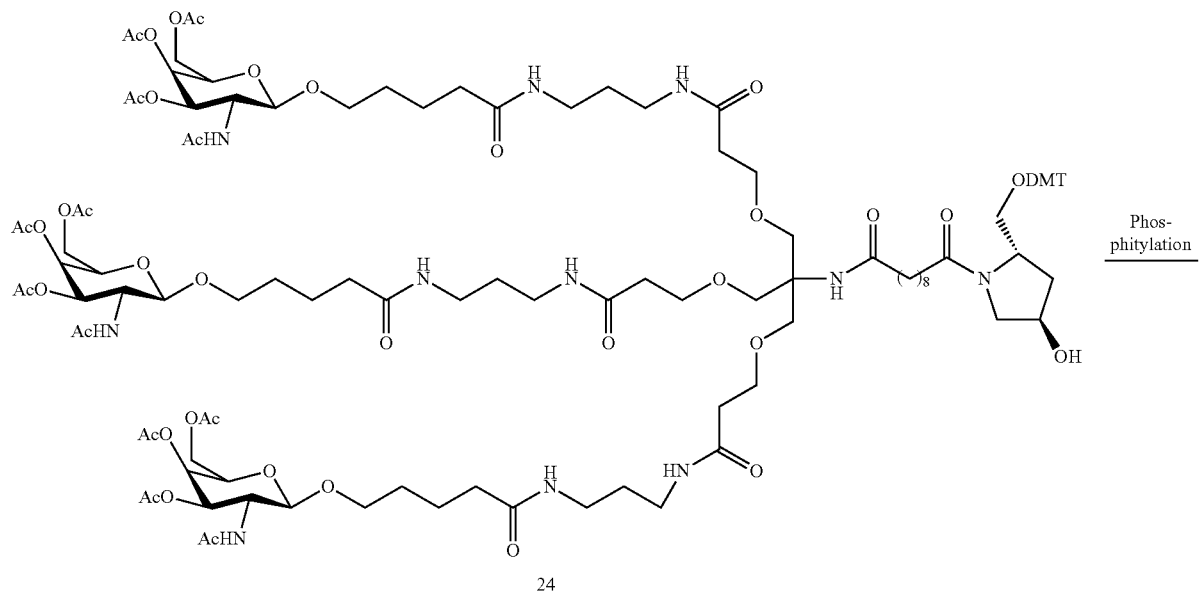

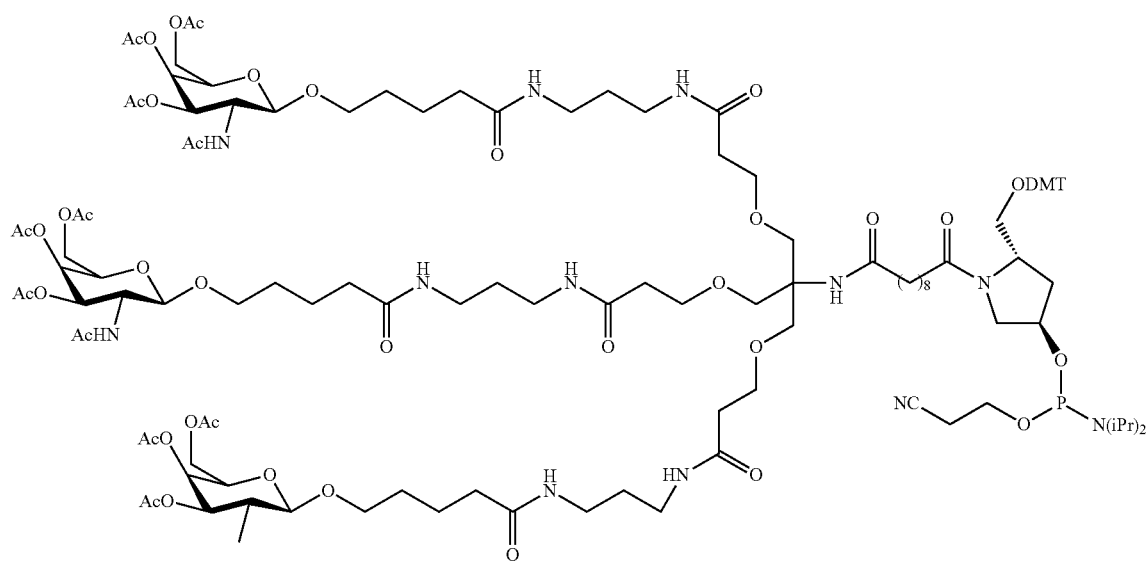
26
Compound 24 is prepared as per the procedures illustrated in Example 6.
Example 9
General Preparation of Conjugated ASOs Comprising GalNAc₃-1 at the 3' Terminus, Compound 29
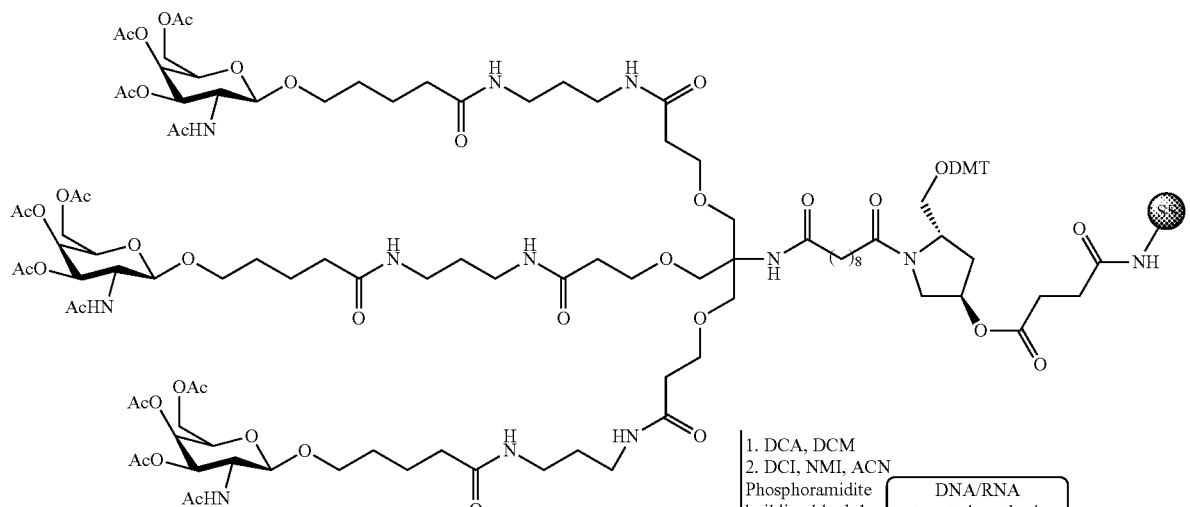

-continued
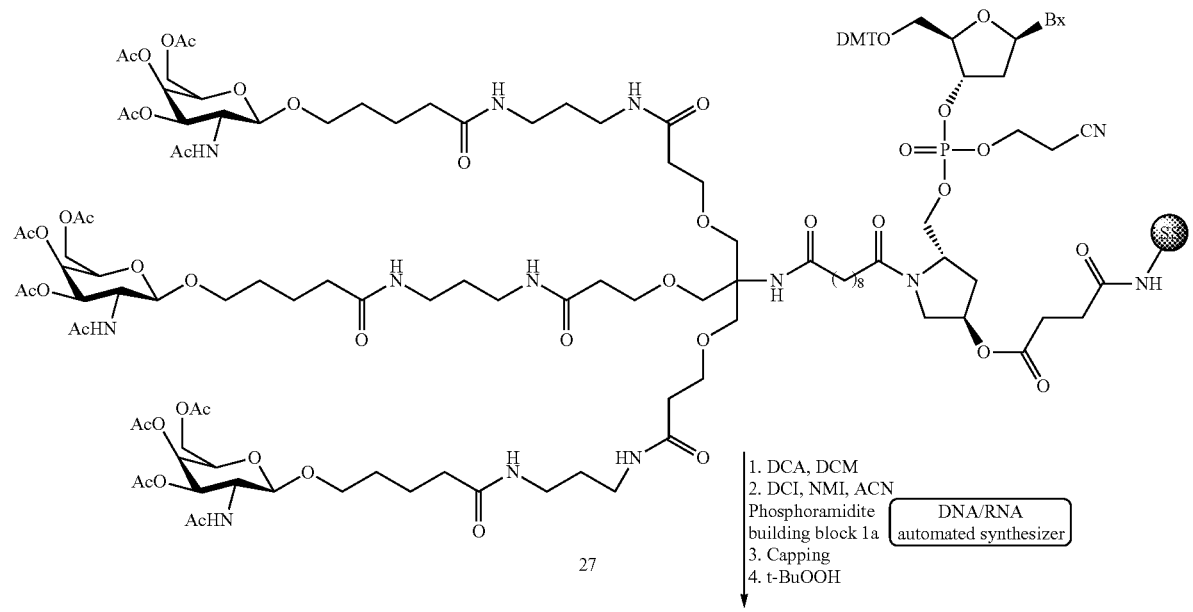
27
1. DCA, DCM
2. DCI, NMI, ACN
   Phosphoramidite
   building block 1a
3. Capping
4. t-BuOOH
DNA/RNA automated synthesizer
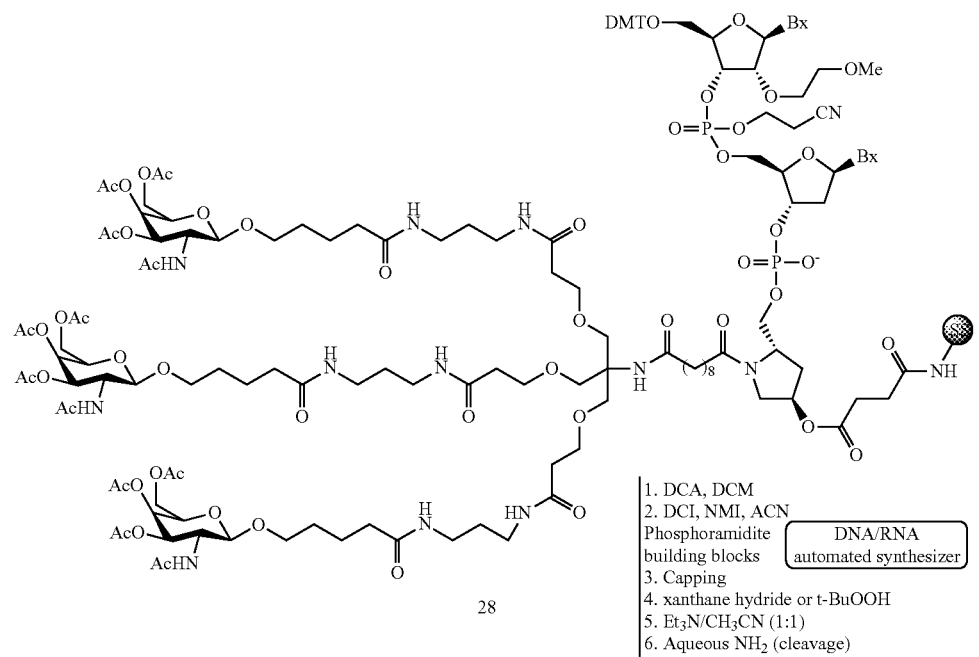
28
1. DCA, DCM
2. DCI, NMI, ACN
   Phosphoramidite
   building blocks
3. Capping
4. xanthane hydride or t-BuOOH
5. Et₃N/CH₃CN (1:1)
6. Aqueous NH₂ (cleavage)
DNA/RNA automated synthesizer
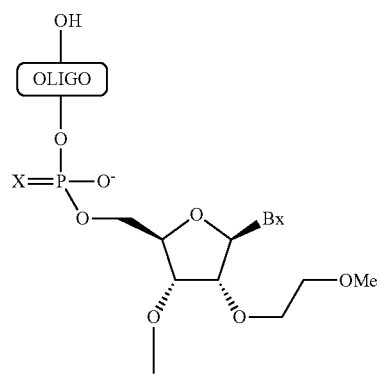

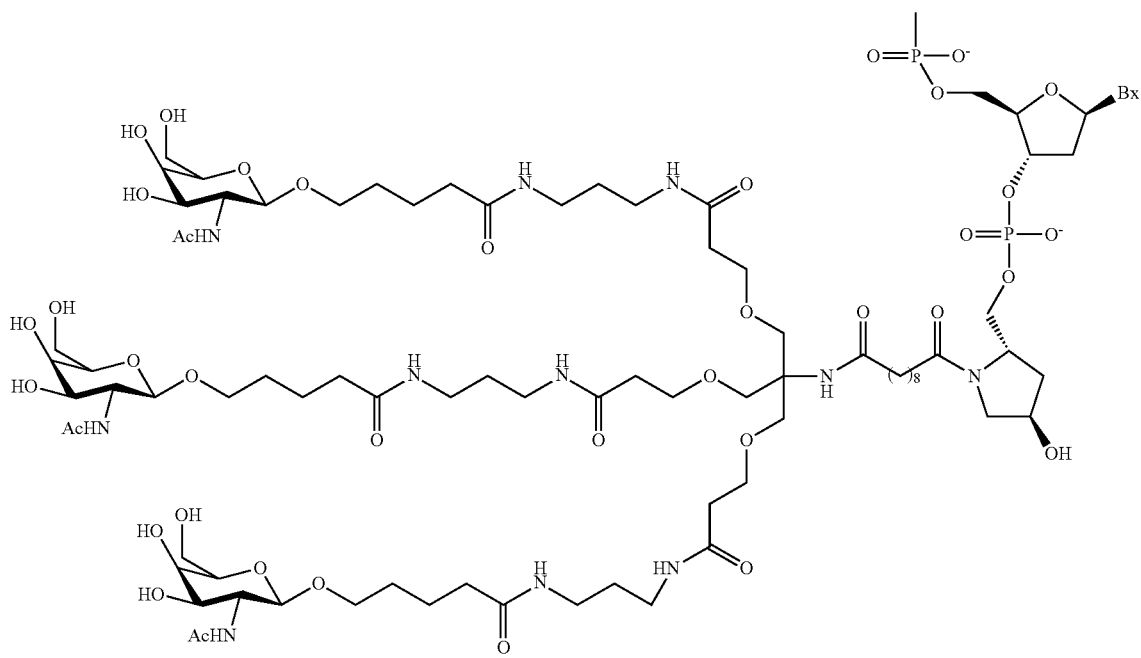
Bx = Heterocyclic base
X = O or S
Wherein the protected GalNAc$_3$-1 has the structure:
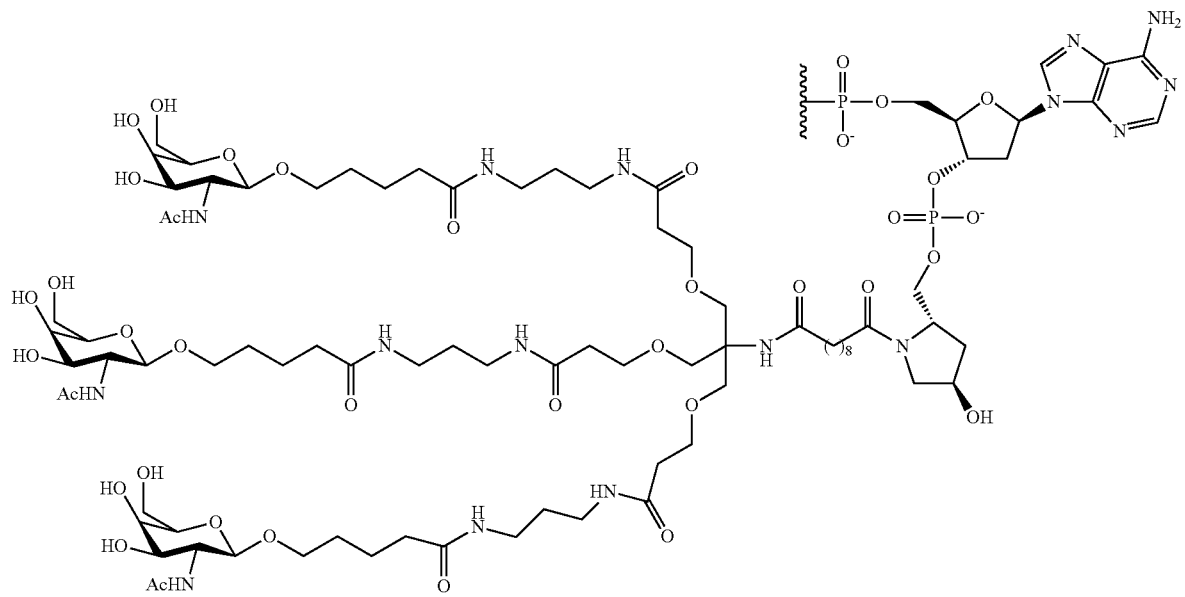
The GalNAc$_3$ cluster portion of the conjugate group GalNAc$_3$-1 (GalNAc$_3$-1$_a$) can be combined with any cleavable moiety to provide a variety of conjugate groups. Wherein GalNAc$_3$-1$_a$ has the formula:

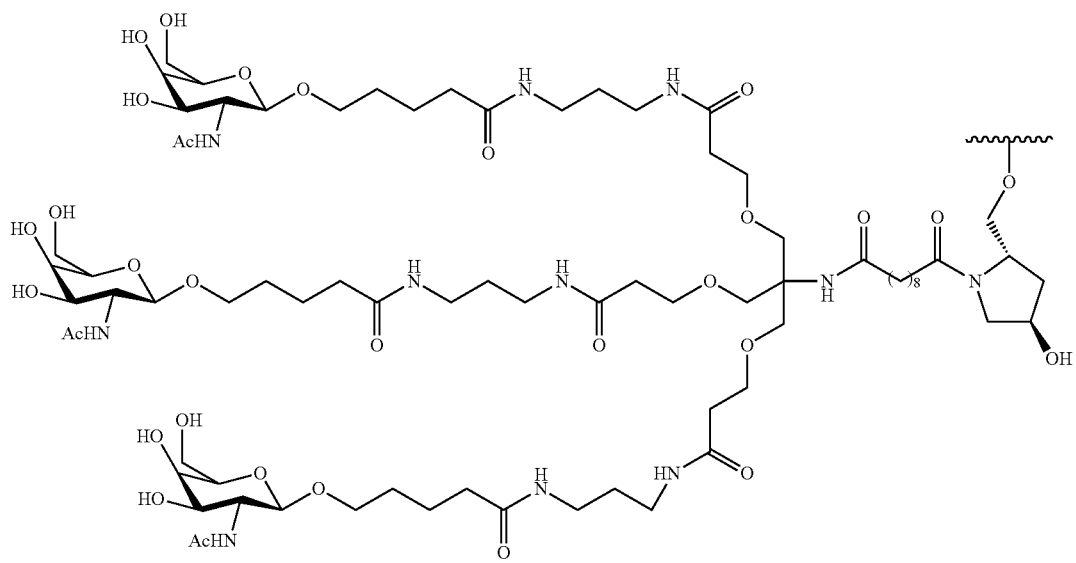

The solid support bound protected GalNAc$_3$-1, Compound 25, was prepared as per the procedures illustrated in Example 7. Oligomeric Compound 29 comprising GalNAc$_3$-1 at the 3' terminus was prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare oligomeric compounds having a predetermined sequence and composition. The order and quantity of phosphoramidites added to the solid support can be adjusted to prepare gapped oligomeric compounds as described herein. Such gapped oligomeric compounds can have predetermined composition and base sequence as dictated by any given target.

Example 10

General Preparation Conjugated ASOs Comprising GalNAc$_3$-1 at the 5' Terminus, Compound 34

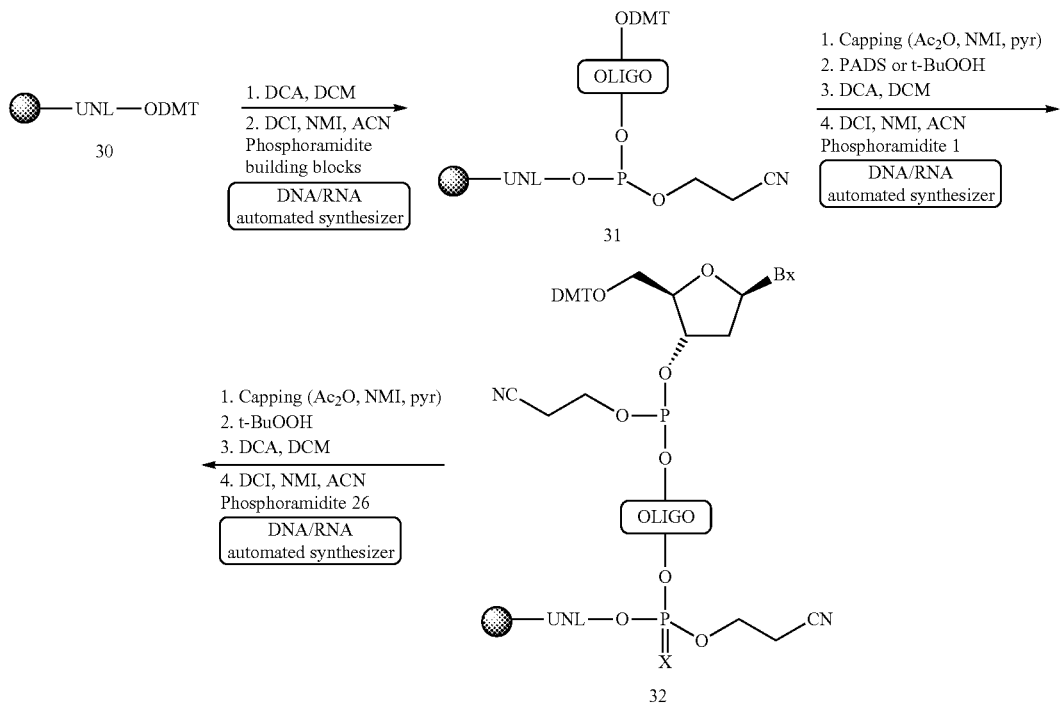

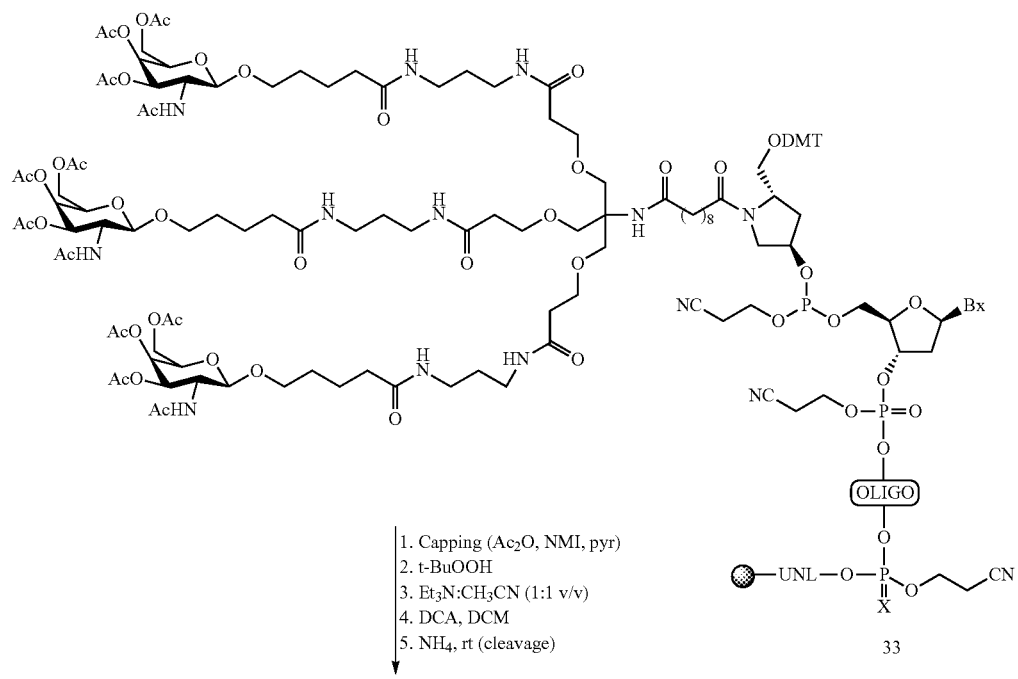

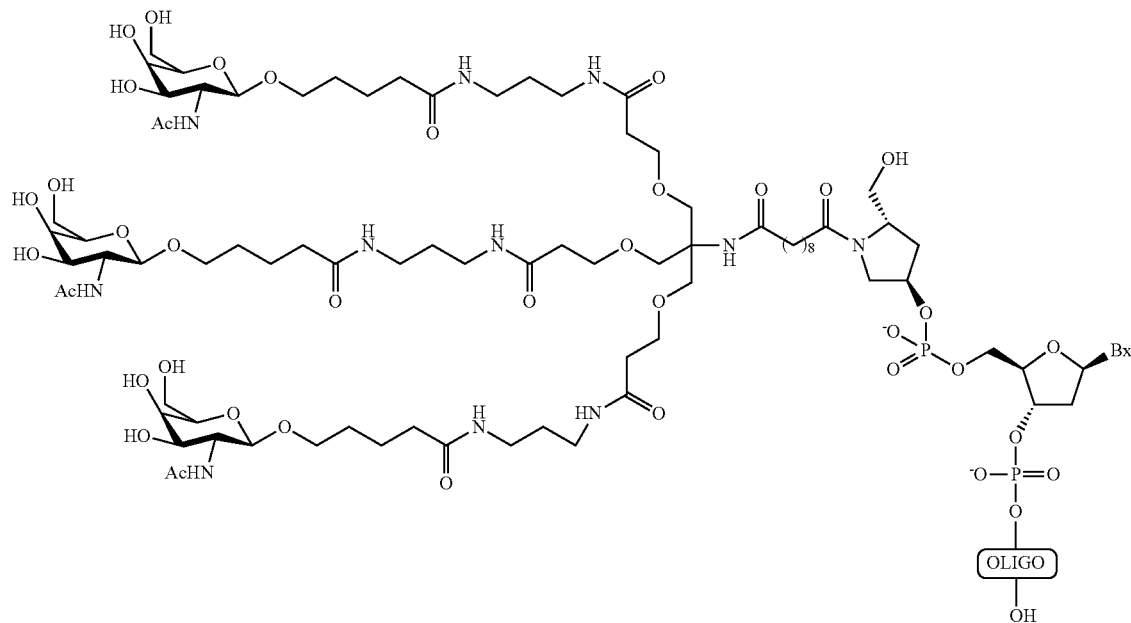

34

X = O, or S
Bx = Hererocyclic base

The Unylinker™ 30 is commercially available. Oligomeric Compound 34 comprising a GalNAc$_3$-1 cluster at the 5' terminus is prepared using standard procedures in automated DNA/RNA synthesis (see Dupouy et al., *Angew. Chem. Int. Ed.*, 2006, 45, 3623-3627). Phosphoramidite building blocks, Compounds 1 and 1a were prepared as per the procedures illustrated in Example 1. The phosphoramidites illustrated are meant to be representative and not intended to be limiting as other phosphoramidite building blocks can be used to prepare an oligomeric compound having a predetermined sequence and composition. The order and quantity of phosphoramidites added to the solid support can be adjusted to prepare gapped oligomeric compounds as described herein. Such gapped oligomeric compounds can have predetermined composition and base sequence as dictated by any given target.

Example 11
Preparation of Compound 39
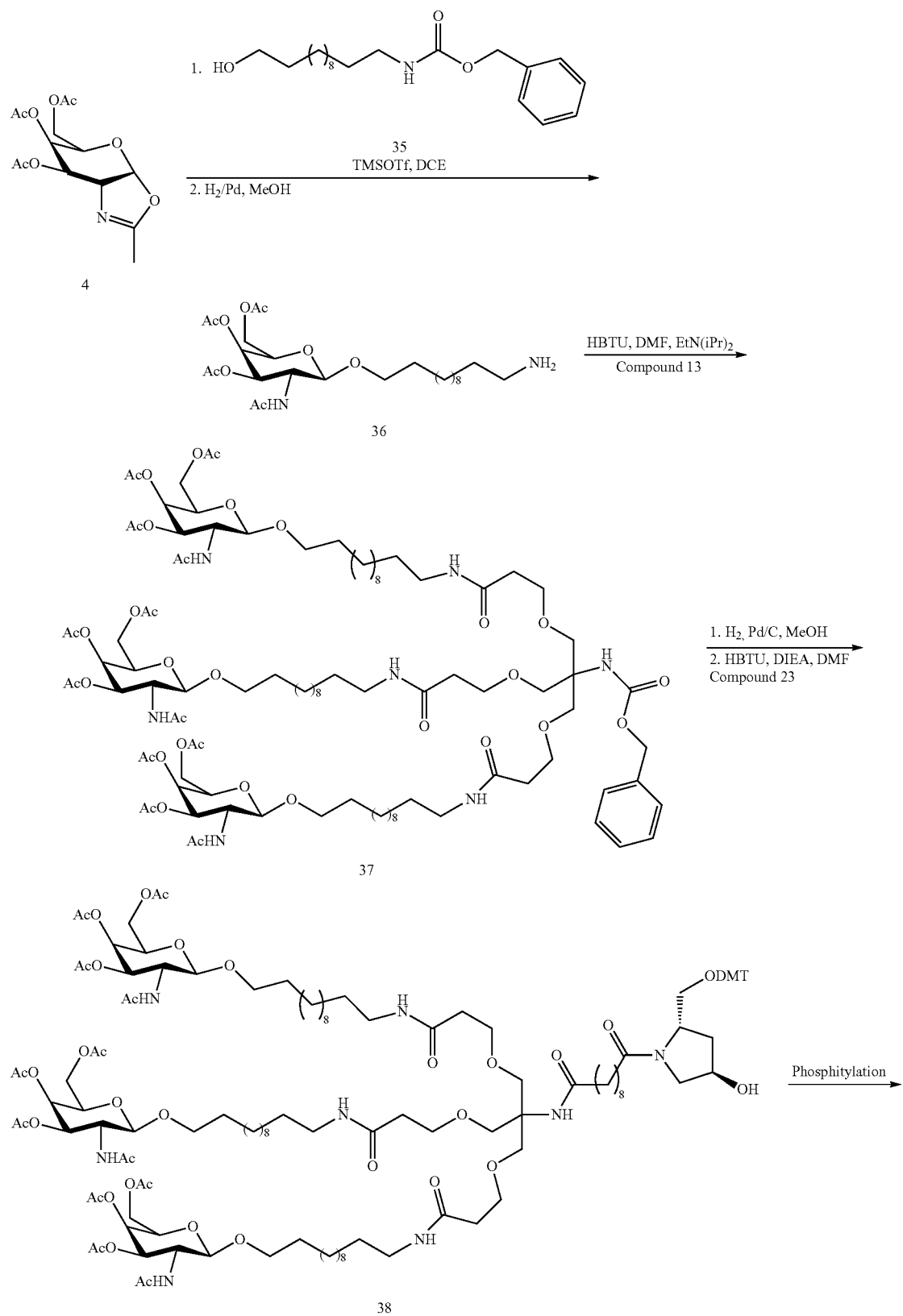

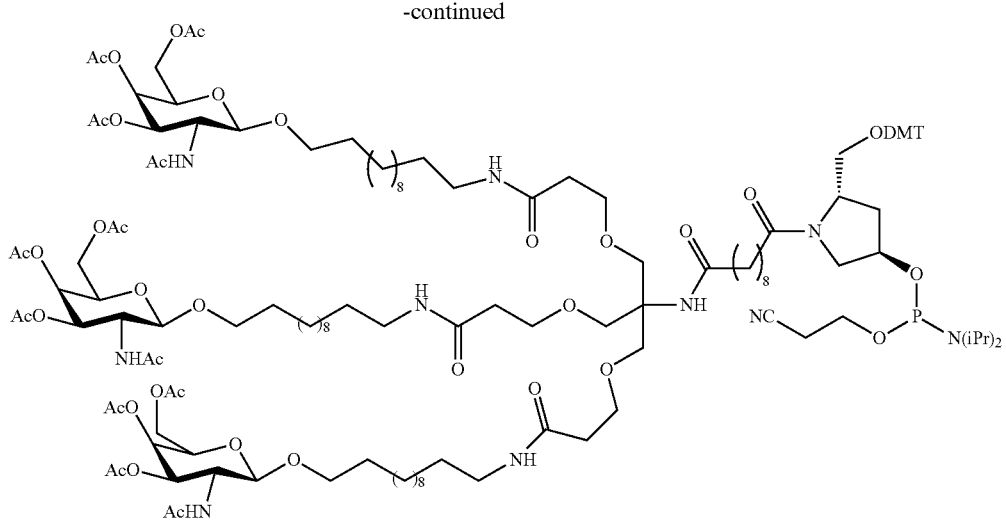
39
Compounds 4, 13 and 23 were prepared as per the procedures illustrated in Examples 2, 4, and 5. Compound 35 is prepared using similar procedures published in Rouchaud et al., *Eur. J. Org. Chem.*, 2011, 12, 2346-2353.
Example 12
Preparation of Compound 40
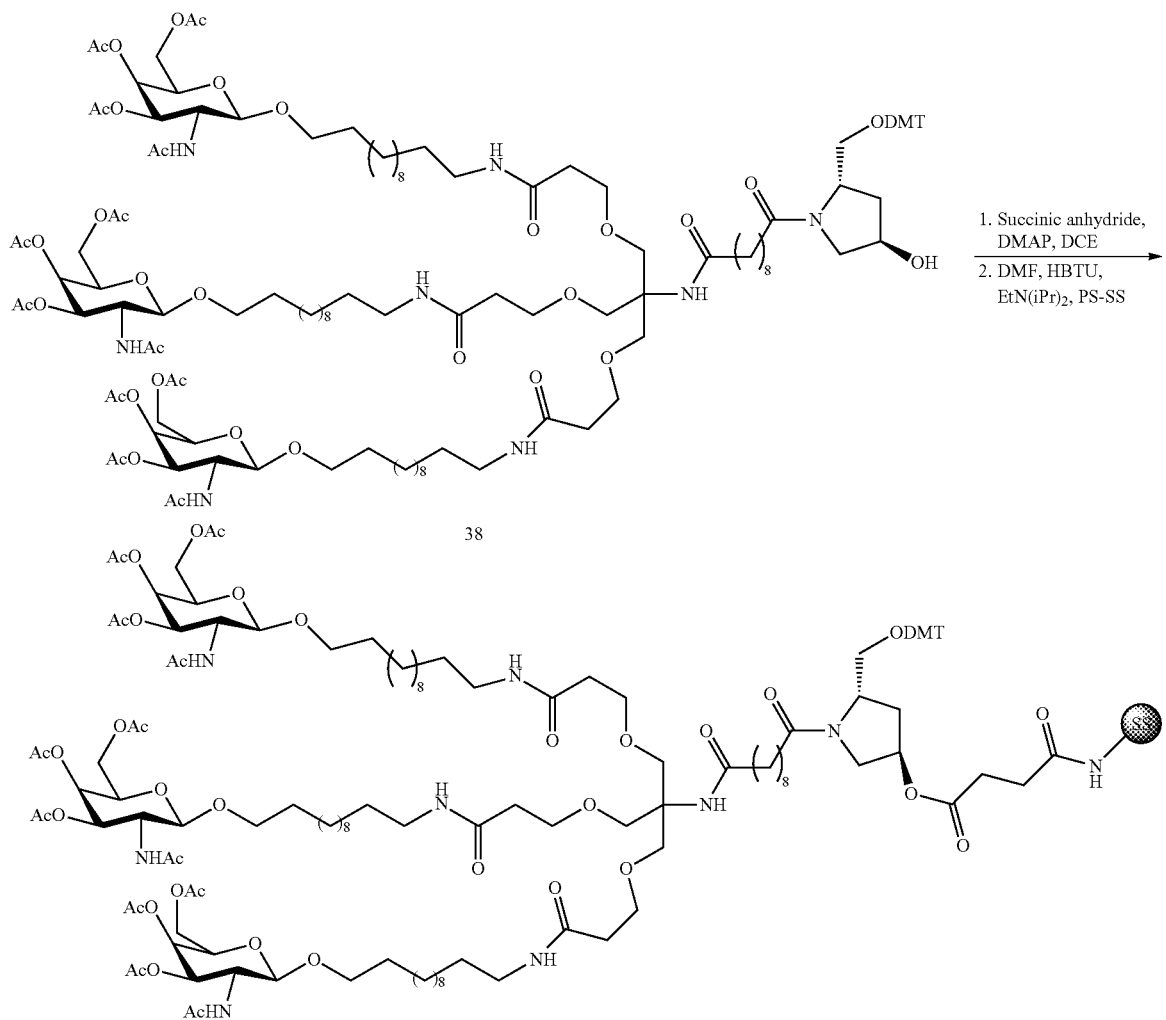

Compound 38 is prepared as per the procedures illustrated in Example 11.
Example 13
Preparation of Compound 44
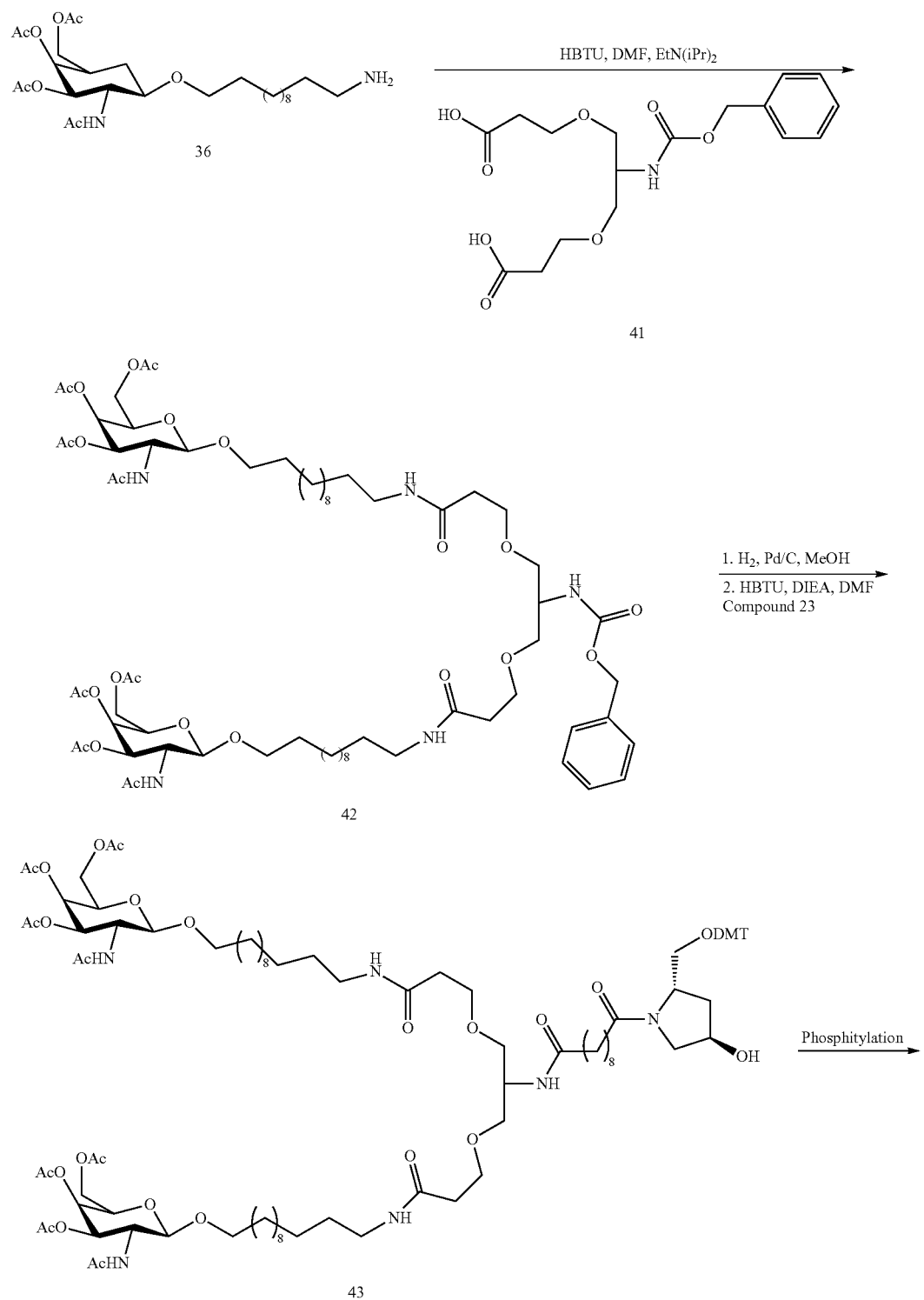

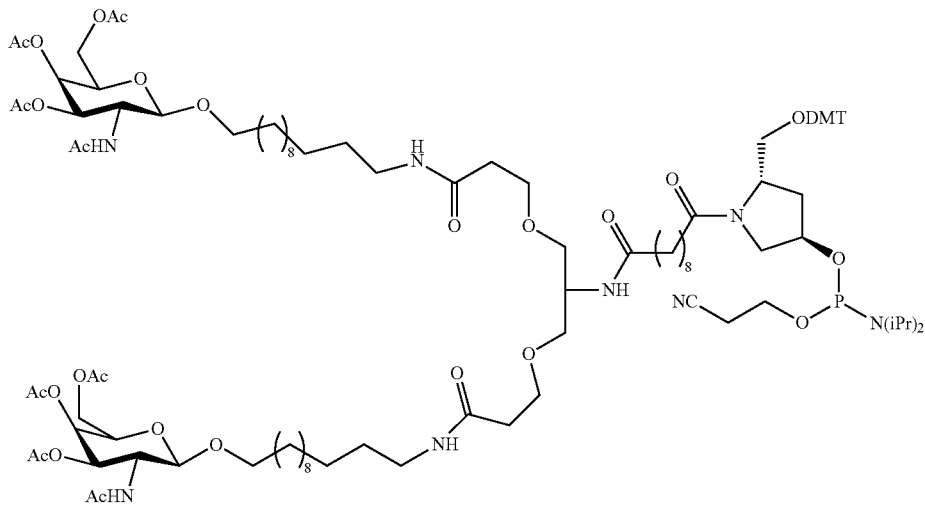
44
Compounds 23 and 36 are prepared as per the procedures illustrated in Examples 5 and 11. Compound 41 is prepared using similar procedures published in WO 2009082607.
Example 14
Preparation of Compound 45
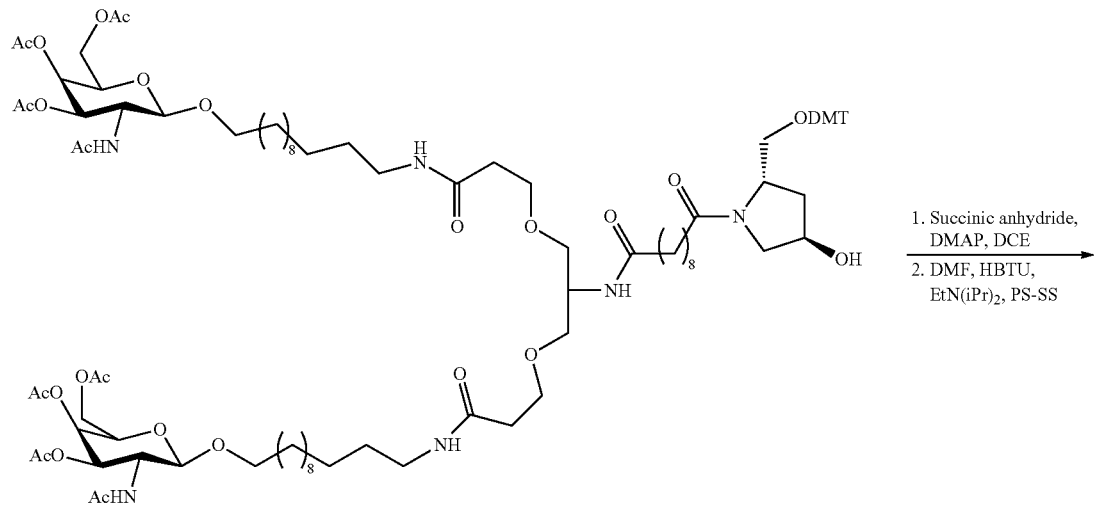
43

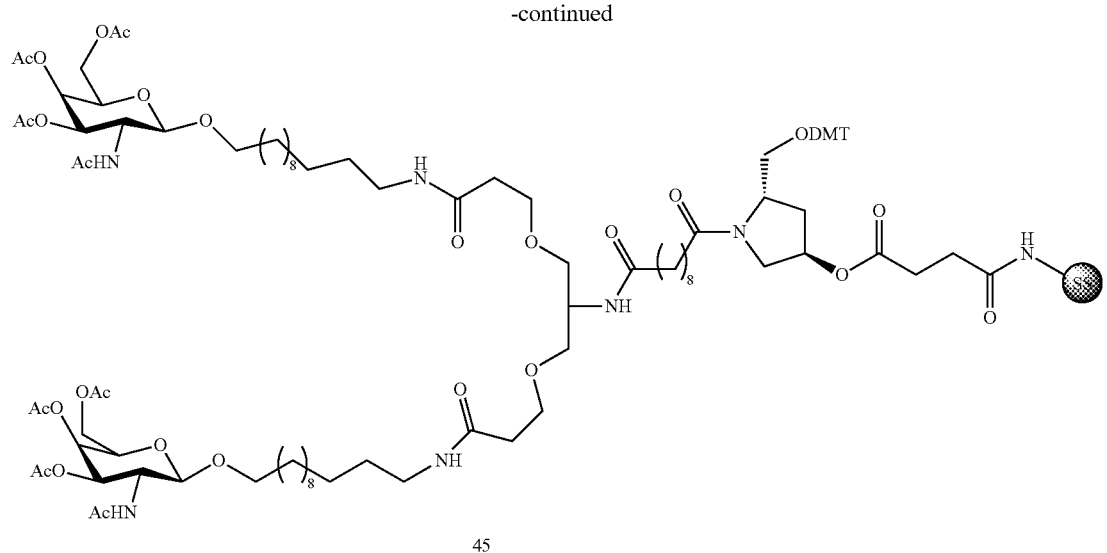
45
Compound 43 is prepared as per the procedures illustrated in Example 13.
Example 15
Preparation of Compound 47
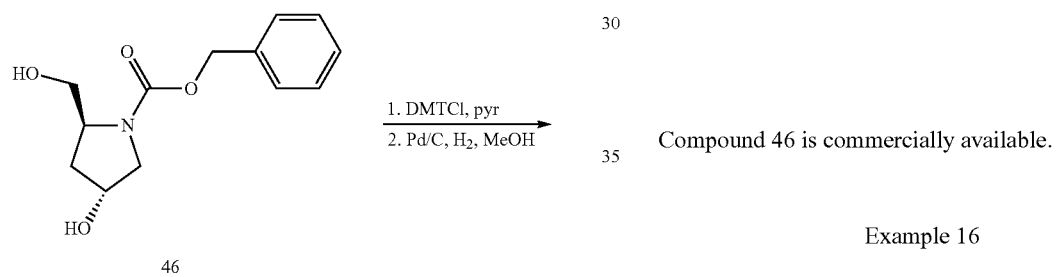
Compound 46 is commercially available.
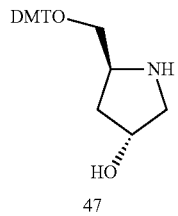
Example 16
Preparation of Compound 53
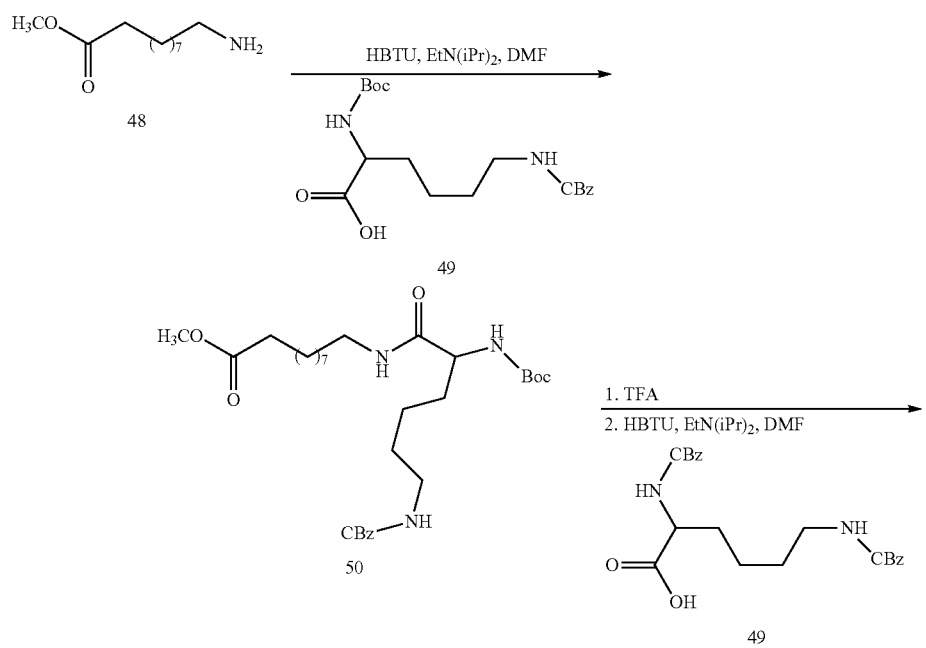

-continued
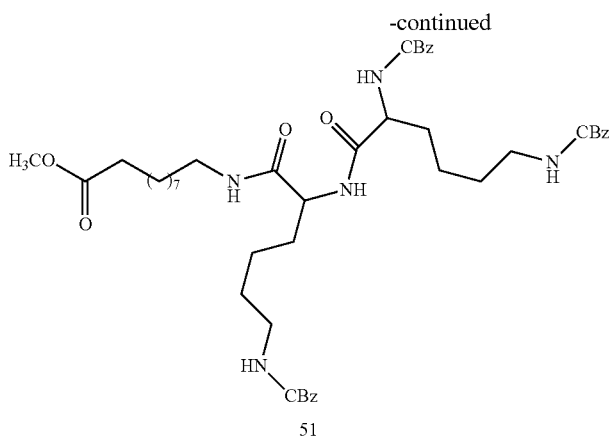
51
1. LiOH, MeOH
2. HBTU, EtN(iPr)$_2$, DMF
Compound 47
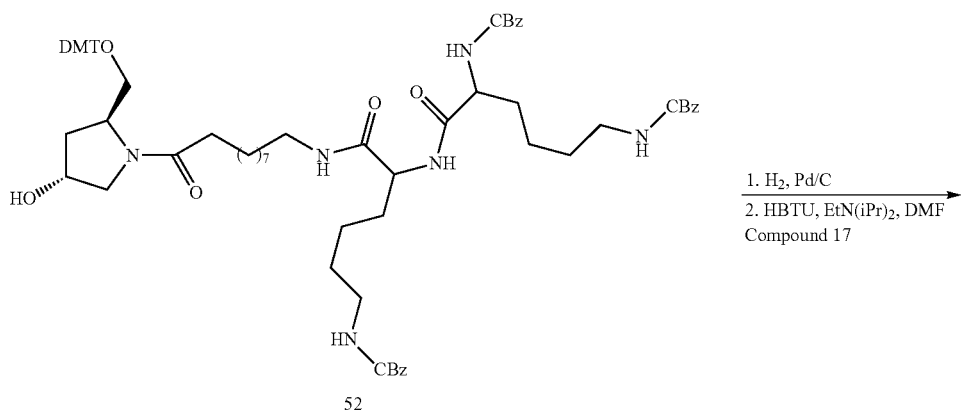
52
1. H$_2$, Pd/C
2. HBTU, EtN(iPr)$_2$, DMF
Compound 17
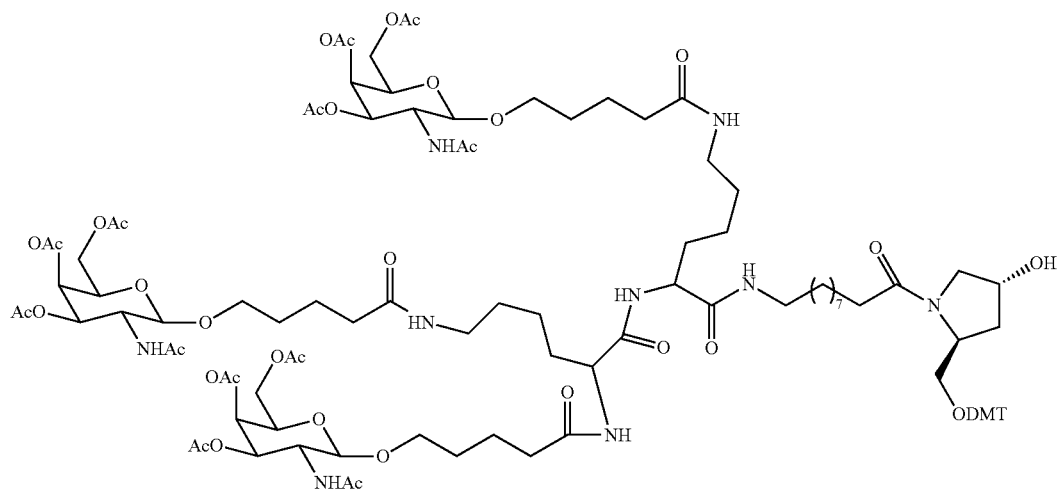
53

Compounds 48 and 49 are commercially available. Compounds 17 and 47 are prepared as per the procedures illustrated in Examples 4 and 15.
Example 17
Preparation of Compound 54
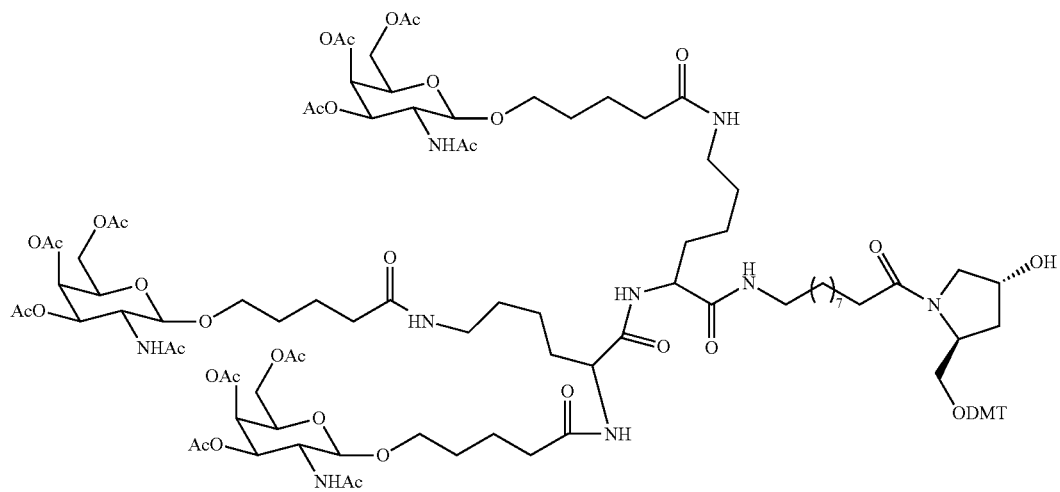
53
↓ Phosphitylation
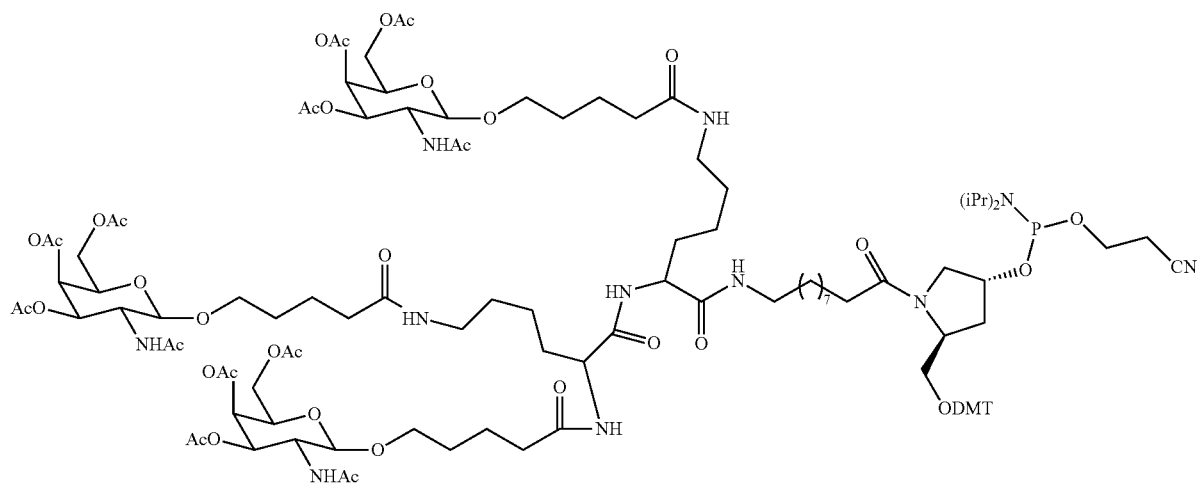
54

Compound 53 is prepared as per the procedures illustrated in Example 16.

Example 18

Preparation of Compound 55

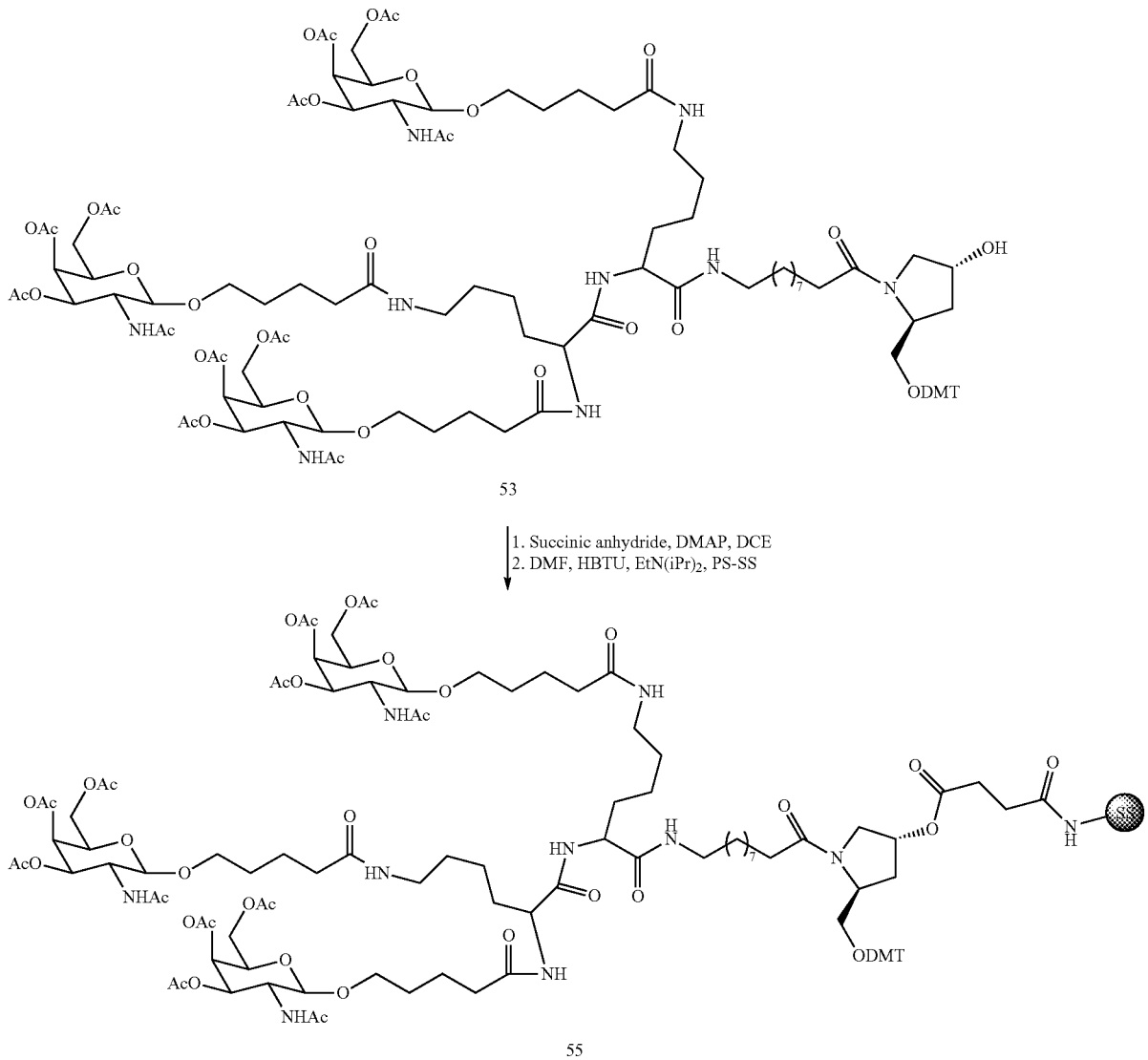

Compound 53 is prepared as per the procedures illustrated in Example 16.

Example 19

General Method for the Preparation of Conjugated ASOs Comprising GalNAc$_3$-1 at the 3' Position Via Solid Phase Techniques (Preparation of ISIS 647535, 647536 and 651900)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues. A 0.1 M solution of phosphoramidite in anhydrous acetonitrile was used for β-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on an GalNAc$_3$-1 loaded VIMAD solid support (110 μmol/g, Guzaev et al., 2003) packed in the column. For the coupling step, the phosphoramidites were delivered 4 fold excess over the loading on the solid support and phosphoramidite condensation was carried out for 10 min. All other steps followed standard protocols supplied by the manufacturer. A solution of 6% dichloroacetic acid in toluene was used for removing dimethoxytrityl (DMT) group from 5'-hydroxyl group of the nucleotide. 4,5-Dicyanoimidazole (0.7 M) in anhydrous CH$_3$CN was used as activator during coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 1:1 (v/v) mixture of triethylamine and acetonitrile with a contact time of 45 minutes. The solid-support bound ASOs were suspended in aqueous ammonia (28-30 wt %) and heated at 55° C. for 6 h.

The unbound ASOs were then filtered and the ammonia was boiled off. The residue was purified by high pressure liquid chromatography on a strong anion exchange column (GE Healthcare Bioscience, Source 30Q, 30 μm, 2.54×8 cm, A=100 mM ammonium acetate in 30% aqueous $CH_3CN$, B=1.5 M NaBr in A, 0-40% of B in 60 min, flow 14 mL min-1, $\lambda$=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

Antisense oligonucleotides not comprising a conjugate were synthesized using standard oligonucleotide synthesis procedures well known in the art.

Using these methods, three separate antisense compounds targeting ApoC III were prepared. As summarized in Table 17, below, each of the three antisense compounds targeting ApoC III had the same nucleobase sequence; ISIS 304801 is a 5-10-5 MOE gapmer having all phosphorothioate linkages; ISIS 647535 is the same as ISIS 304801, except that it had a $GalNAc_3$-1 conjugated at its 3'end; and ISIS 647536 is the same as ISIS 647535 except that certain internucleoside linkages of that compound are phosphodiester linkages. As further summarized in Table 17, two separate antisense compounds targeting SRB-1 were synthesized. ISIS 440762 was a 2-10-2 cEt gapmer with all phosphorothioate internucleoside linkages; ISIS 651900 is the same as ISIS 440762, except that it included a $GalNAc_3$-1 at its 3'-end.

ine, which is part of the conjugate. Thus, in the above table, the sequences could also be listed as ending with "$GalNAc_3$-1" with the "$A_{do}$" omitted. This convention of using the subscript "a" to indicate the portion of a conjugate group lacking a cleavable nucleoside or cleavable moiety is used throughout these Examples. This portion of a conjugate group lacking the cleavable moiety is referred to herein as a "cluster" or "conjugate cluster" or "$GalNAc_3$ cluster." In certain instances it is convenient to describe a conjugate group by separately providing its cluster and its cleavable moiety.

Example 20

Dose-Dependent Antisense Inhibition of Human ApoC III in huApoC III Transgenic Mice ISIS 304801 and ISIS 647535, each targeting human ApoC III and described above, were separately tested and evaluated in a dose-dependent study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once a week for two weeks with ISIS 304801 or 647535 at 0.08, 0.25, 0.75, 2.25 or 6.75 μmol/kg or with PBS as a control. Each treatment group consisted of 4 animals. Forty-eight hours after the administration of the last dose, blood was drawn from each mouse and the mice were sacrificed and tissues were collected.

ApoC III mRNA Analysis

ApoC III mRNA levels in the mice's livers were determined using real-time PCR and RIBOGREEN® RNA quan-

TABLE 17

Modified ASO targeting ApoC III and SRB-1

| ASO | Sequence (5' to 3') | Target | CalCd Mass | Observed Mass | SEQ ID No. |
|---|---|---|---|---|---|
| ISIS 304801 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | ApoC III | 7165.4 | 7164.4 | 4878 |
| ISIS 647535 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_{eo}A_{do}$-$GalNAc_3$-$1_a$ | ApoC III | 9239.5 | 9237.8 | 4879 |
| ISIS 647536 | $A_{es}G_{eo}{}^mC_{eo}T_{eo}T_{eo}{}^mC_{ds}T_{ds}T_{ds}G_{ds}T_{ds}{}^mC_{ds}{}^mC_{ds}A_{ds}G_{ds}{}^mC_{ds}T_{eo}T_{eo}T_{es}A_{es}T_{eo}A_{do}$-$GalNAc_3$-$1_a$ | ApoC III | 9142.9 | 9140.8 | 4879 |
| ISIS 440762 | $T_{ks}{}^mC_{ks}A_{ds}G_{ds}T_{ds}{}^mC_{ds}A_{ds}T_{ds}G_{ds}A_{ds}{}^mC_{ds}T_{ds}T_{ks}{}^mC_k$ | SRB-1 | 4647.0 | 4646.4 | 4880 |
| ISIS 651900 | $T_{ks}{}^mC_{ks}A_{ds}G_{ds}T_{ds}{}^mC_{ds}A_{ds}T_{ds}G_{ds}A_{ds}{}^mC_{ds}T_{ds}T_{ks}{}^mC_{ko}A_{do}$-$GalNAc_3$-$1_a$ | SRB-1 | 6721.1 | 6719.4 | 4881 |

Subscripts: "e" indicates 2'-MOE modified nucleoside; "d" indicates β-D-2'-deoxyribonucleoside; "k" indicates 6'-(S)—$CH_3$ bicyclic nucleoside (e.g. cEt); "s" indicates phosphorothioate internucleoside linkages (PS); "o" indicates phosphodiester internucleoside linkages (PO); and "o" indicates —O—P(=O)(OH)—. Superscript "m" indicates 5-methylcytosines. "$GalNAc_3$-1" indicates a conjugate group having the structure shown previously in Example 9. Note that $GalNAc_3$-1 comprises a cleavable adenosine which links the ASO to remainder of the conjugate, which is designated "$GalNAc_3$-$1_a$." This nomenclature is used in the above table to show the full nucleobase sequence, including the adenostification reagent (Molecular Probes, Inc. Eugene, Oreg.) according to standard protocols. ApoC III mRNA levels were determined relative to total RNA (using Ribogreen), prior to normalization to PBS-treated control. The results below are presented as the average percent of ApoC III mRNA levels for each treatment group, normalized to PBS-treated control and are denoted as "% PBS". The half maximal effective dosage ($ED_{50}$) of each ASO is also presented in Table 18, below.

As illustrated, both antisense compounds reduced ApoC III RNA relative to the PBS control. Further, the antisense compound conjugated to $GalNAc_3$-1 (ISIS 647535) was substantially more potent than the antisense compound lacking the $GalNAc_3$-1 conjugate (ISIS 304801).

TABLE 18

Effect of ASO treatment on ApoC III mRNA levels in human ApoC III transgenic mice

| ASO | Dose (μmol/kg) | % PBS | ED$_{50}$ (μmol/kg) | 3' Conjugate | Internucleoside linkage/Length | SEQ ID No. |
|---|---|---|---|---|---|---|
| PBS | 0 | 100 | — | — | — | |
| ISIS 304801 | 0.08 | 95 | 0.77 | None | PS/20 | 4878 |
| | 0.75 | 42 | | | | |
| | 2.25 | 32 | | | | |
| | 6.75 | 19 | | | | |
| ISIS 647535 | 0.08 | 50 | 0.074 | GalNAc$_3$-1 | PS/20 | 4879 |
| | 0.75 | 15 | | | | |
| | 2.25 | 17 | | | | |
| | 6.75 | 8 | | | | |

ApoC III Protein Analysis (Turbidometric Assay)

Plasma ApoC III protein analysis was determined using procedures reported by Graham et al, *Circulation Research*, published online before print Mar. 29, 2013.

Approximately 100 μl of plasma isolated from mice was analyzed without dilution using an Olympus Clinical Analyzer and a commercially available turbidometric ApoC III assay (Kamiya, Cat# KAI-006, Kamiya Biomedical, Seattle, Wash.). The assay protocol was performed as described by the vendor.

As shown in the Table 19 below, both antisense compounds reduced ApoC III protein relative to the PBS control. Further, the antisense compound conjugated to GalNAc$_3$-1 (ISIS 647535) was substantially more potent than the antisense compound lacking the GalNAc$_3$-1 conjugate (ISIS 304801).

TABLE 19

Effect of ASO treatment on ApoC III mRNA levels in human ApoC III transgenic mice

| ASO | Dose (μmol/kg) | % PBS | ED$_{50}$ (μmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 86 | 0.73 | None | PS/20 | 4878 |
| | 0.75 | 51 | | | | |
| | 2.25 | 23 | | | | |
| | 6.75 | 13 | | | | |
| ISIS 647535 | 0.08 | 72 | 0.19 | GalNAc$_3$-1 | PS/20 | 4879 |
| | 0.75 | 14 | | | | |
| | 2.25 | 12 | | | | |
| | 6.75 | 11 | | | | |

Plasma triglycerides and cholesterol were extracted by the method of Bligh and Dyer (Bligh, E. G. and Dyer, W. J. Can. J. Biochem. Physiol. 37: 911-917, 1959)(Bligh, E and Dyer, W, *Can J Biochem Physiol*, 37, 911-917, 1959)(Bligh, E and Dyer, W, *Can J Biochem Physiol*, 37, 911-917, 1959) and measured by using a Beckmann Coulter clinical analyzer and commercially available reagents.

The triglyceride levels were measured relative to PBS injected mice and are denoted as "% PBS". Results are presented in Table 20. As illustrated, both antisense compounds lowered triglyceride levels. Further, the antisense compound conjugated to GalNAc$_3$-1 (ISIS 647535) was substantially more potent than the antisense compound lacking the GalNAc$_3$-1 conjugate (ISIS 304801).

TABLE 20

Effect of ASO treatment on triglyceride levels in transgenic mice

| ASO | Dose (μmol/kg) | % PBS | ED$_{50}$ (μmol/kg) | 3' Conjugate | Internucleoside Linkage/Length | SEQ ID No. |
|---|---|---|---|---|---|---|
| PBS | 0 | 100 | — | — | — | |
| ISIS 304801 | 0.08 | 87 | 0.63 | None | PS/20 | 4878 |
| | 0.75 | 46 | | | | |
| | 2.25 | 21 | | | | |
| | 6.75 | 12 | | | | |
| ISIS 647535 | 0.08 | 65 | 0.13 | GalNAc$_3$-1 | PS/20 | 4879 |
| | 0.75 | 9 | | | | |
| | 2.25 | 8 | | | | |
| | 6.75 | 9 | | | | |

Plasma samples were analyzed by HPLC to determine the amount of total cholesterol and of different fractions of cholesterol (HDL and LDL). Results are presented in Tables 21 and 22. As illustrated, both antisense compounds lowered total cholesterol levels; both lowered LDL; and both raised HDL. Further, the antisense compound conjugated to GalNAc$_3$-1 (ISIS 647535) was substantially more potent than the antisense compound lacking the GalNAc$_3$-1 conjugate (ISIS 304801). An increase in HDL and a decrease in LDL levels is a cardiovascular beneficial effect of antisense inhibition of ApoC III.

TABLE 21

Effect of ASO treatment on total cholesterol levels in transgenic mice

| ASO | Dose (μmol/kg) | Total Cholesterol (mg/dL) | 3' Conjugate | Internucleoside Linkage/Length | SEQ ID No. |
|---|---|---|---|---|---|
| PBS | 0 | 257 | — | — | |
| ISIS 304801 | 0.08 | 226 | None | PS/20 | 4878 |
| | 0.75 | 164 | | | |
| | 2.25 | 110 | | | |
| | 6.75 | 82 | | | |
| ISIS 647535 | 0.08 | 230 | GalNAc$_3$-1 | PS/20 | 4879 |
| | 0.75 | 82 | | | |
| | 2.25 | 86 | | | |
| | 6.75 | 99 | | | |

TABLE 22

Effect of ASO treatment on HDL and LDL cholesterol levels in transgenic mice

| ASO | Dose (μmol/kg) | HDL (mg/dL) | LDL (mg/dL) | 3' Conjugate | Internucleoside Linkage/Length | SEQ ID No. |
|---|---|---|---|---|---|---|
| PBS | 0 | 17 | 28 | — | — | |
| ISIS | 0.08 | 17 | 23 | None | PS/20 | 4878 |

TABLE 22-continued

Effect of ASO treatment on HDL and LDL cholesterol levels in transgenic mice

| ASO | Dose (μmol/kg) | HDL (mg/dL) | LDL (mg/dL) | 3' Conjugate | Internucleoside Linkage/Length | SEQ ID No. |
|---|---|---|---|---|---|---|
| 304801 | 0.75 | 27 | 12 | | | |
| | 2.25 | 50 | 4 | | | |
| | 6.75 | 45 | 2 | | | |
| ISIS 647535 | 0.08 | 21 | 21 | GalNAc$_3$-1 | PS/20 | 4879 |
| | 0.75 | 44 | 2 | | | |
| | 2.25 | 50 | 2 | | | |
| | 6.75 | 58 | 2 | | | |

Pharmacokinetics Analysis (PK)

The PK of the ASOs was also evaluated. Liver and kidney samples were minced and extracted using standard protocols. Samples were analyzed on MSD1 utilizing IP-HPLC-MS. The tissue level (μg/g) of full-length ISIS 304801 and 647535 was measured and the results are provided in Table 23. As illustrated, liver concentrations of total full-length antisense compounds were similar for the two antisense compounds. Thus, even though the GalNAc$_3$-1-conjugated antisense compound is more active in the liver (as demonstrated by the RNA and protein data above), it is not present at substantially higher concentration in the liver. Indeed, the calculated EC$_{50}$ (provided in Table 23) confirms that the observed increase in potency of the conjugated compound cannot be entirely attributed to increased accumulation. This result suggests that the conjugate improved potency by a mechanism other than liver accumulation alone, possibly by improving the productive uptake of the antisense compound into cells.

The results also show that the concentration of GalNAc$_3$-1 conjugated antisense compound in the kidney is lower than that of antisense compound lacking the GalNAc conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly, for non-kidney targets, kidney accumulation is undesired. These data suggest that GalNAc$_3$-1 conjugation reduces kidney accumulation.

TABLE 23

PK analysis of ASO treatment in transgenic mice

| ASO | Dose (μmol/kg) | Liver (μg/g) | Kidney (μg/g) | Liver EC$_{50}$ (μg/g) | 3' Conjugate | Internucleoside Linkage/Length | SEQ ID No. |
|---|---|---|---|---|---|---|---|
| ISIS 304801 | 0.1 | 5.2 | 2.1 | 53 | None | PS/20 | 4878 |
| | 0.8 | 62.8 | 19.6 | | | | |
| | 2.3 | 142.3 | 191.5 | | | | |
| | 6.8 | 202.3 | 337.7 | | | | |
| ISIS 647535 | 0.1 | 3.8 | 0.7 | 3.8 | GalNAc$_3$-1 | PS/20 | 4879 |
| | 0.8 | 72.7 | 34.3 | | | | |
| | 2.3 | 106.8 | 111.4 | | | | |
| | 6.8 | 237.2 | 179.3 | | | | |

Metabolites of ISIS 647535 were also identified and their masses were confirmed by high resolution mass spectrometry analysis. The cleavage sites and structures of the observed metabolites are shown below. The relative % of full length ASO was calculated using standard procedures and the results are presented in Table 23a. The major metabolite of ISIS 647535 was full-length ASO lacking the entire conjugate (i.e. ISIS 304801), which results from cleavage at cleavage site A, shown below. Further, additional metabolites resulting from other cleavage sites were also observed. These results suggest that introducing other cleavable bonds such as esters, peptides, disulfides, phosphoramidates or acyl-hydrazones between the GalNAc$_3$-1 sugar and the ASO, which can be cleaved by enzymes inside the cell, or which may cleave in the reductive environment of the cytosol, or which are labile to the acidic pH inside endosomes and lyzosomes, can also be useful.

TABLE 23a

Observed full length metabolites of ISIS 647535

| Metabolite | ASO | Cleavage site | Relative % |
|---|---|---|---|
| 1 | ISIS 304801 | A | 36.1 |
| 2 | ISIS 304801 + dA | B | 10.5 |
| 3 | ISIS 647535 minus [3 GalNAc] | C | 16.1 |
| 4 | ISIS 647535 minus [3 GalNAc + 1 5-hydroxy-pentanoic acid tether] | D | 17.6 |
| 5 | ISIS 647535 minus [2 GalNAc + 2 5-hydroxy-pentanoic acid tether] | D | 9.9 |
| 6 | ISIS 647535 minus [3 GalNAc + 3 5-hydroxy-pentanoic acid tether] | D | 9.8 |

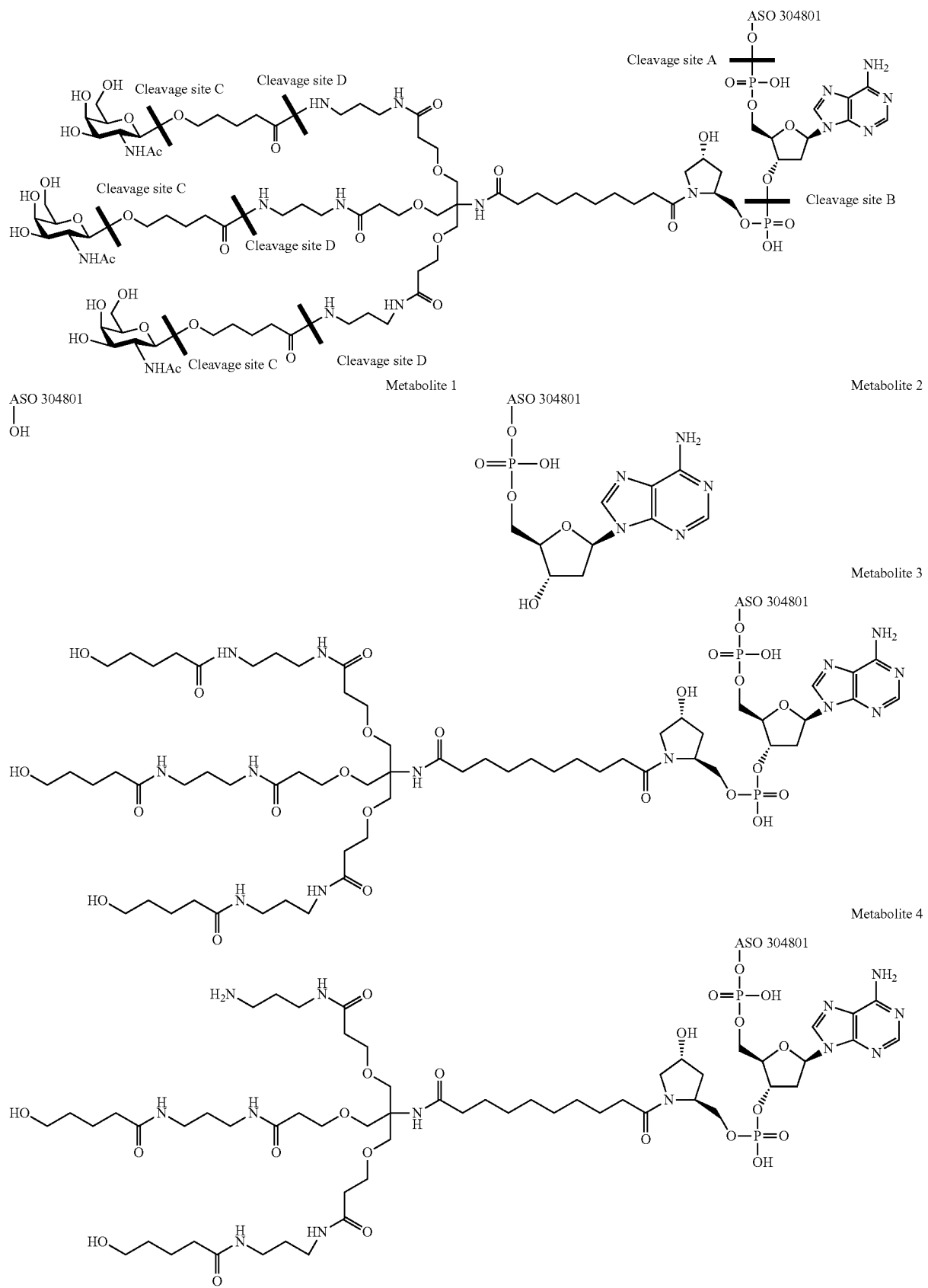

-continued

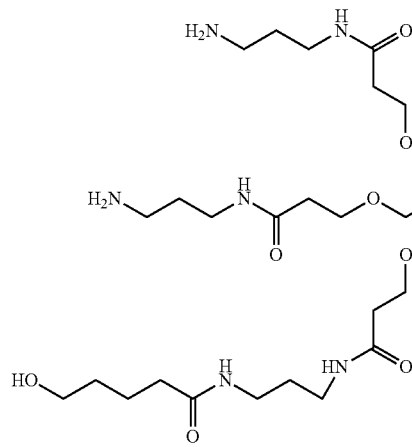
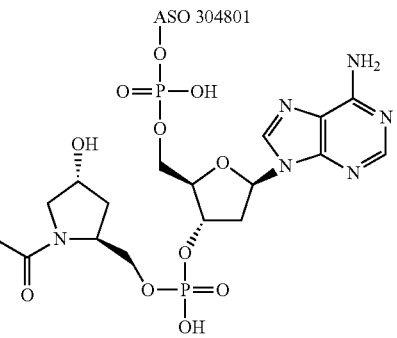

Metabolite 5

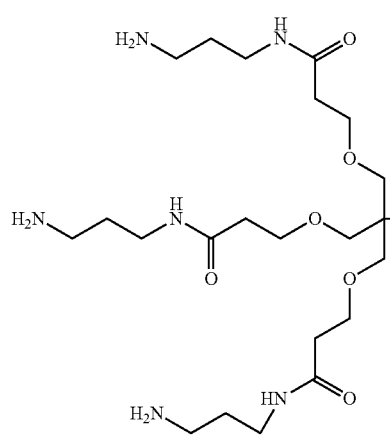
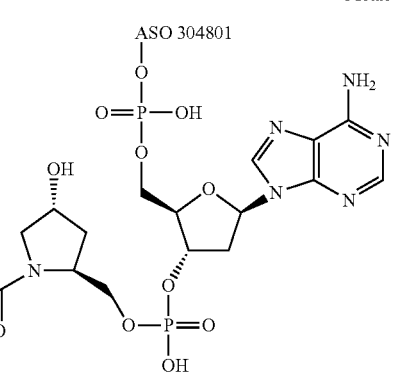

Metabolite 6

Example 21

Antisense Inhibition of Human ApoC III in Human ApoC III Transgenic Mice in Single Administration Study ISIS 304801, 647535 and 647536 each targeting human ApoC III and described in Table 17, were further evaluated in a single administration study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once at the dosage shown below with ISIS 304801, 647535 or 647536 (described above) or with PBS treated control. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III mRNA and protein levels in the liver; plasma triglycerides; and cholesterol, including HDL and LDL fractions were assessed as described above (Example 20). Data from those analyses are presented in Tables 24-28, below. Liver transaminase levels, alanine aminotransferase (ALT) and aspartate aminotransferase (AST), in serum were measured relative to saline injected mice using standard protocols. The ALT and AST levels showed that the antisense compounds were well tolerated at all administered doses.

These results show improvement in potency for antisense compounds comprising a GalNAc$_3$-1 conjugate at the 3' terminus (ISIS 647535 and 647536) compared to the antisense compound lacking a GalNAc$_3$-1 conjugate (ISIS 304801). Further, ISIS 647536, which comprises a GalNAc$_3$-1 conjugate and some phosphodiester linkages was as potent as ISIS 647535, which comprises the same conjugate and all internucleoside linkages within the ASO are phosphorothioate.

TABLE 24

Effect of ASO treatment on ApoC III mRNA levels in human ApoC III transgenic mice

| ASO | Dose (mg/kg) | % PBS | $ED_{50}$ (mg/kg) | 3' Conjugate | Internucleoside linkage/Length | SEQ ID No. |
|---|---|---|---|---|---|---|
| PBS | 0 | 99 | — | — | — | |
| ISIS 304801 | 1 | 104 | 13.2 | None | PS/20 | 4878 |
| | 3 | 92 | | | | |
| | 10 | 71 | | | | |
| | 30 | 40 | | | | |
| ISIS 647535 | 0.3 | 98 | 1.9 | GalNAc$_3$-1 | PS/20 | 4879 |
| | 1 | 70 | | | | |
| | 3 | 33 | | | | |
| | 10 | 20 | | | | |
| ISIS 647536 | 0.3 | 103 | 1.7 | GalNAc$_3$-1 | PS/PO/20 | 4879 |
| | 1 | 60 | | | | |
| | 3 | 31 | | | | |
| | 10 | 21 | | | | |

TABLE 25

Effect of ASO treatment on ApoC III plasma protein levels in human ApoC III transgenic mice

| ASO | Dose (mg/kg) | % PBS | $ED_{50}$ (mg/kg) | 3' Conjugate | Internucleoside Linkage/Length | SEQ ID No. |
|---|---|---|---|---|---|---|
| PBS | 0 | 99 | — | — | — | |
| ISIS 304801 | 1 | 104 | 23.2 | None | PS/20 | 4878 |
| | 3 | 92 | | | | |
| | 10 | 71 | | | | |
| | 30 | 40 | | | | |
| ISIS 647535 | 0.3 | 98 | 2.1 | GalNAc$_3$-1 | PS/20 | 4879 |
| | 1 | 70 | | | | |
| | 3 | 33 | | | | |
| | 10 | 20 | | | | |
| ISIS 647536 | 0.3 | 103 | 1.8 | GalNAc$_3$-1 | PS/PO/20 | 4879 |
| | 1 | 60 | | | | |
| | 3 | 31 | | | | |
| | 10 | 21 | | | | |

TABLE 26

Effect of ASO treatment on triglyceride levels in transgenic mice

| ASO | Dose (mg/kg) | % PBS | $ED_{50}$ (mg/kg) | 3' Conjugate | Internucleoside Linkage/Length | SEQ ID No. |
|---|---|---|---|---|---|---|
| PBS | 0 | 98 | — | — | — | |
| ISIS 304801 | 1 | 80 | 29.1 | None | PS/20 | 4878 |
| | 3 | 92 | | | | |
| | 10 | 70 | | | | |
| | 30 | 47 | | | | |
| ISIS 647535 | 0.3 | 100 | 2.2 | GalNAc$_3$-1 | PS/20 | 4879 |
| | 1 | 70 | | | | |
| | 3 | 34 | | | | |
| | 10 | 23 | | | | |
| ISIS 647536 | 0.3 | 95 | 1.9 | GalNAc$_3$-1 | PS/PO/20 | 4879 |
| | 1 | 66 | | | | |
| | 3 | 31 | | | | |
| | 10 | 23 | | | | |

TABLE 27

Effect of ASO treatment on total cholesterol levels in transgenic mice

| ASO | Dose (mg/kg) | % PBS | 3' Conjugate | Internucleoside Linkage/Length | SEQ ID No. |
|---|---|---|---|---|---|
| PBS | 0 | 96 | — | — | |
| ISIS 304801 | 1 | 104 | None | PS/20 | 4878 |
| | 3 | 96 | | | |
| | 10 | 86 | | | |
| | 30 | 72 | | | |
| ISIS 647535 | 0.3 | 93 | GalNAc$_3$-1 | PS/20 | 4879 |
| | 1 | 85 | | | |
| | 3 | 61 | | | |
| | 10 | 53 | | | |
| ISIS 647536 | 0.3 | 115 | GalNAc$_3$-1 | PS/PO/20 | 4879 |
| | 1 | 79 | | | |
| | 3 | 51 | | | |
| | 10 | 54 | | | |

TABLE 28

Effect of ASO treatment on HDL and LDL cholesterol levels in transgenic mice

| ASO | Dose (mg/kg) | HDL % PBS | LDL % PBS | 3' Conjugate | Internucleoside Linkage/Length | SEQ ID No. |
|---|---|---|---|---|---|---|
| PBS | 0 | 131 | 90 | — | — | |
| ISIS 304801 | 1 | 130 | 72 | None | PS/20 | 4878 |
| | 3 | 186 | 79 | | | |
| | 10 | 226 | 63 | | | |
| | 30 | 240 | 46 | | | |
| ISIS 647535 | 0.3 | 98 | 86 | GalNAc$_3$-1 | PS/20 | 4879 |
| | 1 | 214 | 67 | | | |
| | 3 | 212 | 39 | | | |
| | 10 | 218 | 35 | | | |
| ISIS 647536 | 0.3 | 143 | 89 | GalNAc$_3$-1 | PS/PO/20 | 4879 |
| | 1 | 187 | 56 | | | |
| | 3 | 213 | 33 | | | |
| | 10 | 221 | 34 | | | |

These results confirm that the GalNAc$_3$-1 conjugate improves potency of an antisense compound. The results also show equal potency of a GalNAc$_3$-1 conjugated antisense compounds where the antisense oligonucleotides have mixed linkages (ISIS 647536 which has six phosphodiester linkages) and a full phosphorothioate version of the same antisense compound (ISIS 647535).

Phosphorothioate linkages provide several properties to antisense compounds. For example, they resist nuclease digestion and they bind proteins resulting in accumulation of compound in the liver, rather than in the kidney/urine. These are desirable properties, particularly when treating an indication in the liver. However, phosphorothioate linkages have also been associated with an inflammatory response. Accordingly, reducing the number of phosphorothioate linkages in a compound is expected to reduce the risk of inflammation, but also lower concentration of the compound in liver, increase concentration in the kidney and urine, decrease stability in the presence of nucleases, and lower overall potency. The present results show that a GalNAc$_3$-1 conjugated antisense compound where certain phosphorothioate linkages have been replaced with phosphodiester linkages is as potent against a target in the liver as a counterpart having full phosphorothioate linkages. Such compounds are expected to be less proinflammatory (See Example 24 describing an experiment showing reduction of PS results in reduced inflammatory effect).

Example 22

Effect of GalNAc₃-1 Conjugated Modified ASO Targeting SRB-1 In Vivo

ISIS 440762 and 651900, each targeting SRB-1 and described in Table 17, were evaluated in a dose-dependent study for their ability to inhibit SRB-1 in Balb/c mice.

Treatment

Six week old male Balb/c mice (Jackson Laboratory, Bar Harbor, Me.) were injected subcutaneously once at the dosage shown below with ISIS 440762, 651900 or with PBS treated control. Each treatment group consisted of 4 animals. The mice were sacrificed 48 hours following the final administration to determine the SRB-1 mRNA levels in liver using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS".

As illustrated in Table 29, both antisense compounds lowered SRB-1 mRNA levels. Further, the antisense compound comprising the GalNAc₃-1 conjugate (ISIS 651900) was substantially more potent than the antisense compound lacking the GalNAc₃-1 conjugate (ISIS 440762). These results demonstrate that the potency benefit of GalNAc₃-1 conjugates are observed using antisense oligonucleotides complementary to a different target and having different chemically modified nucleosides, in this instance modified nucleosides comprise constrained ethyl sugar moieties (a bicyclic sugar moiety).

TABLE 29

Effect of ASO treatment on SRB-1 mRNA levels in Balb/c mice

| ASO | Dose (mg/kg) | Liver % PBS | ED₅₀ (mg/kg) | 3' Conjugate | Internucleoside linkage/ Length | SEQ ID No. |
|---|---|---|---|---|---|---|
| PBS | 0 | 100 | 2.2 | — | — | |
| ISIS 440762 | 0.7 | 85 | | None | PS/14 | 4880 |
| | 2 | 55 | | | | |
| | 7 | 12 | | | | |
| | 20 | 3 | | | | |
| ISIS 651900 | 0.07 | 98 | 0.3 | GalNAc₃-1 | PS/14 | 4881 |
| | 0.2 | 63 | | | | |
| | 0.7 | 20 | | | | |
| | 2 | 6 | | | | |
| | 7 | 5 | | | | |

Example 23

Human Peripheral Blood Mononuclear Cells (hPBMC) Assay Protocol

The hPBMC assay was performed using BD Vautainer CPT tube method. A sample of whole blood from volunteered donors with informed consent at US HealthWorks clinic (Faraday & El Camino Real, Carlsbad) was obtained and collected in 4-15 BD Vacutainer CPT 8 ml tubes (VWR Cat. # BD362753). The approximate starting total whole blood volume in the CPT tubes for each donor was recorded using the PBMC assay data sheet.

The blood sample was remixed immediately prior to centrifugation by gently inverting tubes 8-10 times. CPT tubes were centrifuged at rt (18-25° C.) in a horizontal (swing-out) rotor for 30 min at 1500-1800 RCF with brake off (2700 RPM Beckman Allegra 6R). The cells were retrieved from the buffy coat interface (between Ficoll and polymer gel layers); transferred to a sterile 50 ml conical tube and pooled up to 5 CPT tubes/50 ml conical tube/donor. The cells were then washed twice with PBS (Ca⁺⁺, Mg⁺⁺ free; GIBCO). The tubes were topped up to 50 ml and mixed by inverting several times. The sample was then centrifuged at 330×g for 15 minutes at rt (1215 RPM in Beckman Allegra 6R) and aspirated as much supernatant as possible without disturbing pellet. The cell pellet was dislodged by gently swirling tube and resuspended cells in RPMI+10% FBS+pen/strep (~1 ml/10 ml starting whole blood volume). A 60 µl sample was pipette into a sample vial (Beckman Coulter) with 600 µl VersaLyse reagent (Beckman Coulter Cat# A09777) and was gently vortexed for 10-15 sec. The sample was allowed to incubate for 10 min at rt and being mixed again before counting. The cell suspension was counted on Vicell XR cell viability analyzer (Beckman Coulter) using PBMC cell type (dilution factor of 1:11 was stored with other parameters). The live cell/ml and viability were recorded. The cell suspension was diluted to $1 \times 10^7$ live PBMC/ml in RPMI+10% FBS+pen/strep.

The cells were plated at $5 \times 10^5$ in 50 µl/well of 96-well tissue culture plate (Falcon Microtest). 50 µl/well of 2× concentration oligos/controls diluted in RPMI+10% FBS+pen/strep. was added according to experiment template (100 µl/well total). Plates were placed on the shaker and allowed to mix for approx. 1 min After being incubated for 24 hrs at 37° C.; 5% $CO_2$, the plates were centrifuged at 400×g for 10 minutes before removing the supernatant for MSD cytokine assay (i.e. human IL-6, IL-10, IL-8 and MCP-1).

Example 24

Evaluation of Proinflammatory Effects in hPBMC Assay for GalNAc₃-1 Conjugated ASOs The antisense oligonucleotides (ASOs) listed in Table 30 were evaluated for proinflammatory effect in hPBMC assay using the protocol described in Example 23. ISIS 353512 is an internal standard known to be a high responder for IL-6 release in the assay. The hPBMCs were isolated from fresh, volunteered donors and were treated with ASOs at 0, 0.0128, 0.064, 0.32, 1.6, 8, 40 and 200 µM concentrations. After a 24 hr treatment, the cytokine levels were measured.

The levels of IL-6 were used as the primary readout. The $EC_{50}$ and $E_{max}$ was calculated using standard procedures. Results are expressed as the average ratio of $E_{max}/EC_{50}$ from two donors and is denoted as "$E_{max}/EC_{50}$." The lower ratio indicates a relative decrease in the proinflammatory response and the higher ratio indicates a relative increase in the proinflammatory response.

With regard to the test compounds, the least proinflammatory compound was the PS/PO linked ASO (ISIS 616468). The GalNAc₃-1 conjugated ASO, ISIS 647535 was slightly less proinflammatory than its non-conjugated counterpart ISIS 304801. These results indicate that incorporation of some PO linkages reduces proinflammatory reaction and addition of a GalNAc₃-1 conjugate does not make a compound more proinflammatory and may reduce proinflammatory response. Accordingly, one would expect that an antisense compound comprising both mixed PS/PO linkages and a GalNAc₃-1 conjugate would produce lower proinflammatory responses relative to full PS linked antisense compound with or without a GalNAc$_3$-1 conjugate. These results show that GalNAc$_3$-1 conjugated antisense compounds, particularly those having reduced PS content are less proinflammatory.

Together, these results suggest that a GalNAc$_3$-1 conjugated compound, particularly one with reduced PS content, can be administered at a higher dose than a counterpart full PS antisense compound lacking a GalNAc$_3$-1 conjugate. Since half-life is not expected to be substantially different for these compounds, such higher administration would result in less frequent dosing. Indeed such administration could be even less frequent, because the GalNAc$_3$-1 conjugated compounds are more potent (See Examples 20-22) and re-dosing is necessary once the concentration of a compound has dropped below a desired level, where such desired level is based on potency.

TABLE 30

Modified ASOs

| ASO | Sequence (5' to 3') | Target | SEQ ID No. |
|---|---|---|---|
| ISIS 104838 | $G_{es}{}^mC_{es}T_{es}G_{es}A_{es}T_{ds}T_{ds}A_{ds}G_{ds}A_{ds}G_{ds}A_{ds}G_{ds}A_{ds}G_{ds}G_{es}T_{es}{}^mC_{es}{}^mC_{es}{}^mC_e$ | TNFα | 4882 |
| ISIS 353512 | $T_{es}{}^mC_{es}{}^mC_{es}{}^mC_{ds}A_{ds}T_{ds}T_{ds}{}^mC_{ds}A_{ds}G_{ds}G_{ds}A_{ds}A_{ds}{}^mC_{ds}{}^mC_{ds}T_{es}G_{es}G_e$ | CRP | 4883 |
| ISIS 304801 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_e$ | ApoC III | 4878 |
| ISIS 647535 | $A_{es}G_{es}{}^mC_{es}T_{es}T_{es}{}^mC_{ds}T_{ds}T_{ds}G_{ds}T_{ds}{}^mC_{ds}{}^mC_{ds}A_{ds}G_{ds}{}^mC_{ds}T_{es}T_{es}T_{es}A_{es}T_{eo}A_{do'}$-GalNAc$_3$-1$_a$ | ApoC III | 4879 |
| ISIS 616468 | $A_{es}G_{eo}{}^mC_{eo}T_{eo}T_{eo}{}^mC_{ds}T_{ds}T_{ds}G_{ds}T_{ds}{}^mC_{ds}{}^mC_{ds}A_{ds}G_{ds}{}^mC_{ds}T_{eo}T_{eo}T_{es}A_{es}T_e$ | ApoC III | 4878 |

Subscripts: "e" indicates 2'-MOE modified nucleoside; "d" indicates β-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o" indicates —O—P(=O)(OH)—. Superscript "m" indicates 5-methylcytosines. "A$_{do'}$-GalNAc$_3$-1$_a$" indicates a conjugate having the structure GalNAc$_3$-1 shown in Example 9 attached to the 3'-end of the antisense oligonucleotide, as indicated.

TABLE 31

Proinflammatory Effect of ASOs targeting ApoC III in hPBMC assay

| ASO | EC$_{50}$ (μM) | E$_{max}$ (μM) | E$_{max}$/EC$_{50}$ | 3' Conjugate | Internucleoside Linkage/Length | SEQ ID No. |
|---|---|---|---|---|---|---|
| ISIS 353512 (high responder) | 0.01 | 265.9 | 26,590 | None | PS/20 | 4883 |
| ISIS 304801 | 0.07 | 106.55 | 1,522 | None | PS/20 | 4878 |
| ISIS 647535 | 0.12 | 138 | 1,150 | GalNAc$_3$-1 | PS/20 | 4879 |
| ISIS 616468 | 0.32 | 71.52 | 224 | None | PS/PO/20 | 4878 |

Example 25

Effect of GalNAc$_3$-1 Conjugated Modified ASO Targeting Human ApoC III In Vitro ISIS 304801 and 647535 described above were tested in vitro. Primary hepatocyte cells from transgenic mice at a density of 25,000 cells per well were treated with 0.03, 0.08, 0.24, 0.74, 2.22, 6.67 and 20 μM concentrations of modified oligonucleotides. After a treatment period of approximately 16 hours, RNA was isolated from the cells and mRNA levels were measured by quantitative real-time PCR and the hApoC III mRNA levels were adjusted according to total RNA content, as measured by RIBOGREEN.

The IC$_{50}$ was calculated using the standard methods and the results are presented in Table 32. As illustrated, comparable potency was observed in cells treated with ISIS 647535 as compared to the control, ISIS 304801.

TABLE 32

Modified ASO targeting human ApoC III in primary hepatocytes

| ASO | IC$_{50}$ (μM) | 3' Conjugate | Internucleoside linkage/Length | SEQ ID No. |
|---|---|---|---|---|
| ISIS 304801 | 0.44 | None | PS/20 | 4878 |
| ISIS 647535 | 0.31 | GalNAc$_3$-1 | PS/20 | 4879 |

In this experiment, the large potency benefits of GalNAc$_3$-1 conjugation that are observed in vivo were not observed in vitro. Subsequent free uptake experiments in primary hepatocytes in vitro did show increased potency of oligonucleotides comprising various GalNAc conjugates relative to oligonucleotides that lacking the GalNAc conjugate. (see Examples 60, 82, and 92)

Example 26

Effect of PO/PS Linkages on ApoC III ASO Activity

Human ApoC III transgenic mice were injected intraperitoneally once at 25 mg/kg of ISIS 304801, or ISIS 616468 (both described above) or with PBS treated control once per week for two weeks. The treatment group consisted of 3 animals and the control group consisted of 4 animals. Prior to the treatment as well as after the last dose, blood was drawn from each mouse and plasma samples were analyzed. The mice were sacrificed 72 hours following the last administration.

Samples were collected and analyzed to determine the ApoC III protein levels in the liver as described above (Example 20). Data from those analyses are presented in Table 33, below.

These results show reduction in potency for antisense compounds with PO/PS (ISIS 616468) in the wings relative to full PS (ISIS 304801).

TABLE 33

Effect of ASO treatment on ApoC III protein levels in human ApoC III transgenic mice

| ASO | Dose (mg/kg) | % PBS | 3' Conjugate | Internucleoside linkage/Length | SEQ ID No. |
|---|---|---|---|---|---|
| PBS | 0 | 99 | — | — | |
| ISIS 304801 | 25 mg/kg/wk for 2 wks | 24 | None | Full PS | 4878 |
| ISIS 616468 | 25 mg/kg/wk for 2 wks | 40 | None | 14 PS/6 PO | 4878 |

Example 27

Compound 56

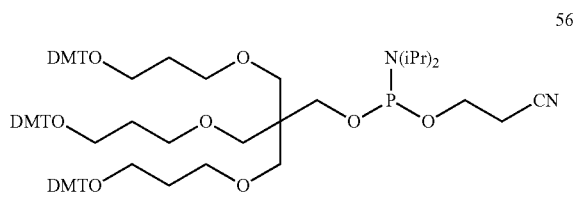

Compound 56 is commercially available from Glen Research or may be prepared according to published procedures reported by Shchepinov et al., *Nucleic Acids Research*, 1997, 25(22), 4447-4454.

Example 28

Preparation of Compound 60

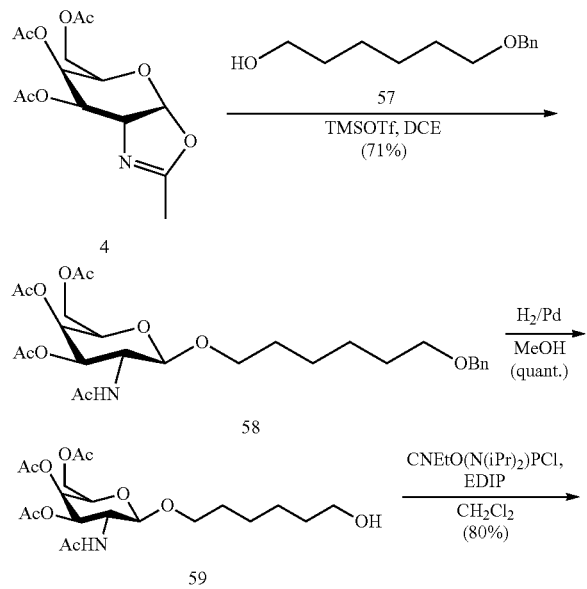

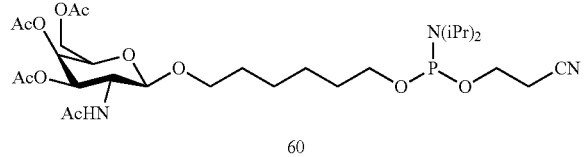

Compound 4 was prepared as per the procedures illustrated in Example 2. Compound 57 is commercially available. Compound 60 was confirmed by structural analysis.

Compound 57 is meant to be representative and not intended to be limiting as other monoprotected substituted or unsubstituted alkyl diols including but not limited to those presented in the specification herein can be used to prepare phosphoramidites having a predetermined composition.

Example 29

Preparation of Compound 63

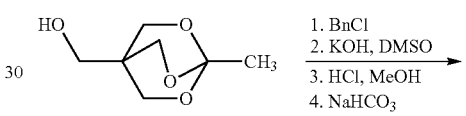

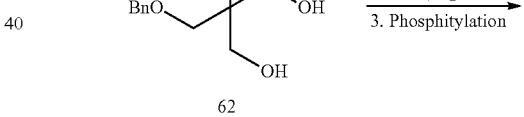

Compounds 61 and 62 are prepared using procedures similar to those reported by Tober et al., *Eur. J. Org. Chem.*, 2013, 3, 566-577; and Jiang et al., *Tetrahedron*, 2007, 63(19), 3982-3988.

Alternatively, Compound 63 is prepared using procedures similar to those reported in scientific and patent literature by Kim et al., *Synlett*, 2003, 12, 1838-1840; and Kim et al., published PCT International Application, WO 2004063208.

Example 30
Preparation of Compound 63b
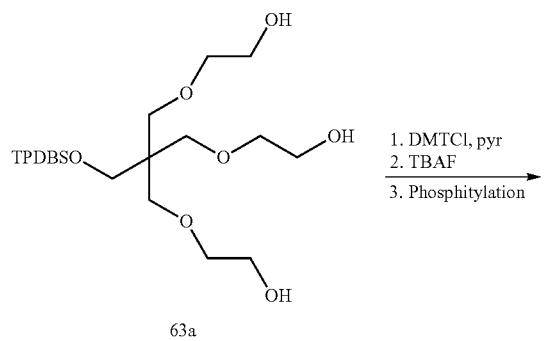
Compound 63a is prepared using procedures similar to those reported by Hanessian et al., *Canadian Journal of Chemistry*, 1996, 74(9), 1731-1737.
Example 31
Preparation of Compound 63d
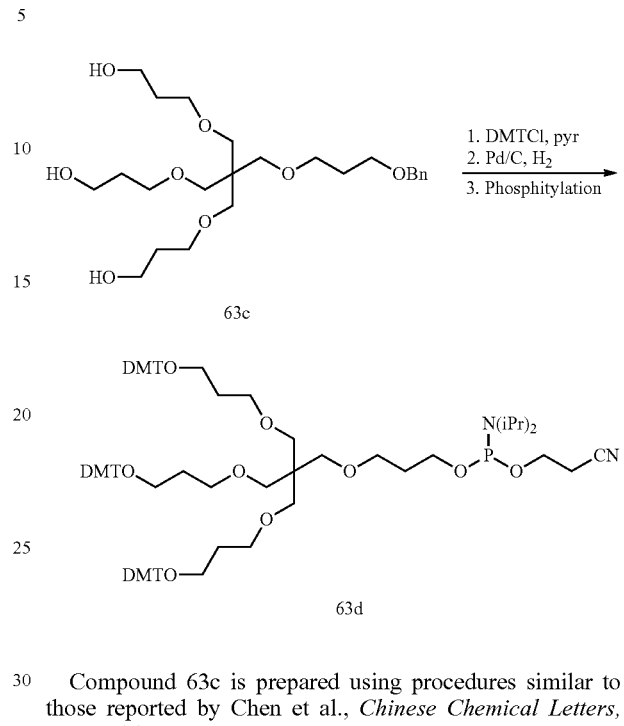
Compound 63c is prepared using procedures similar to those reported by Chen et al., *Chinese Chemical Letters*, 1998, 9(5), 451-453.
Example 32
Preparation of Compound 67
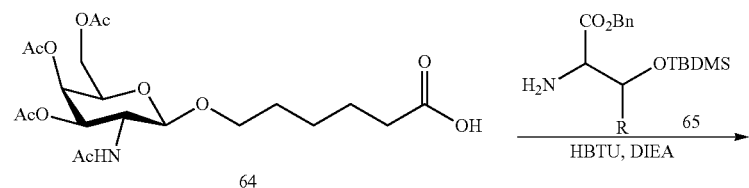
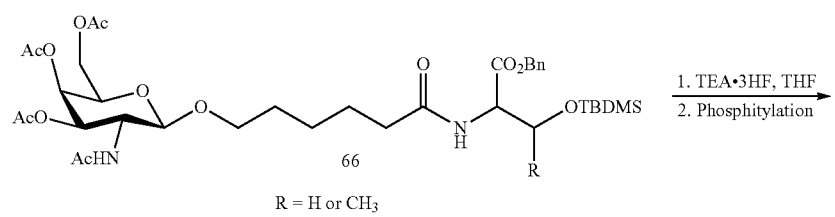
R = H or CH$_3$
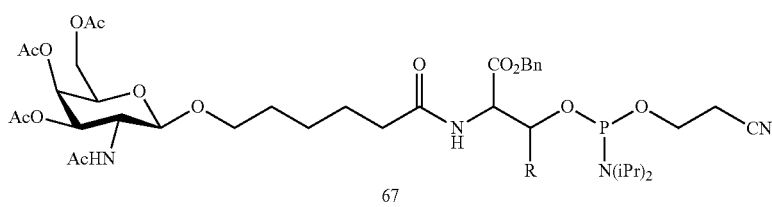

Compound 64 was prepared as per the procedures illustrated in Example 2. Compound 65 is prepared using procedures similar to those reported by Or et al., published PCT International Application, WO 2009/003009. The protecting groups used for Compound 65 are meant to be representative and not intended to be limiting as other protecting groups including but not limited to those presented in the specification herein can be used.

Example 33

Preparation of Compound 70

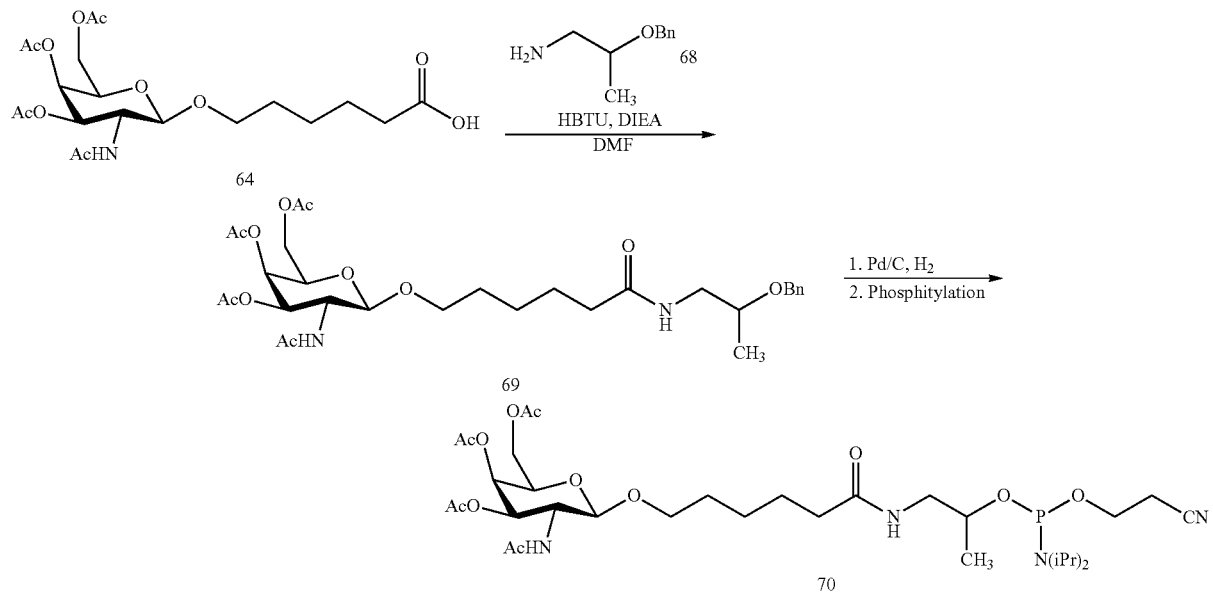

Compound 64 was prepared as per the procedures illustrated in Example 2. Compound 68 is commercially available. The protecting group used for Compound 68 is meant to be representative and not intended to be limiting as other protecting groups including but not limited to those presented in the specification herein can be used.

Example 34

Preparation of Compound 75a

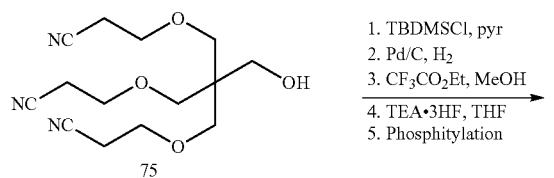

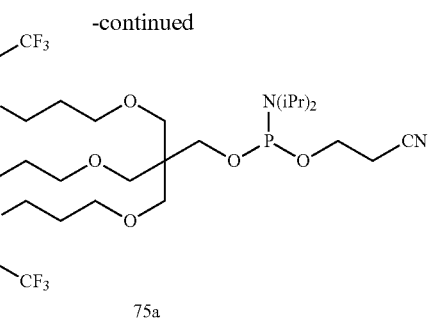

Compound 75 is prepared according to published procedures reported by Shchepinov et al., *Nucleic Acids Research*, 1997, 25(22), 4447-4454.

Example 35

Preparation of Compound 79

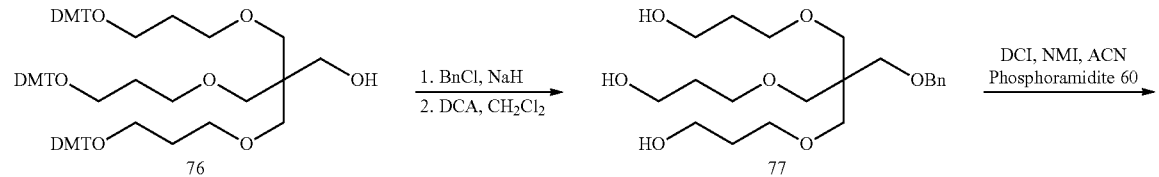

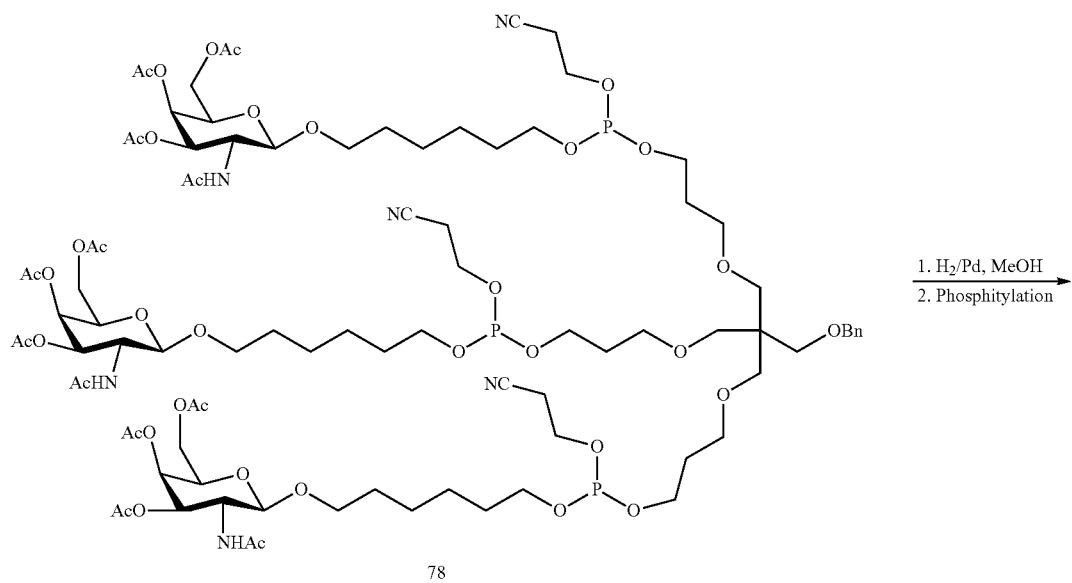
78
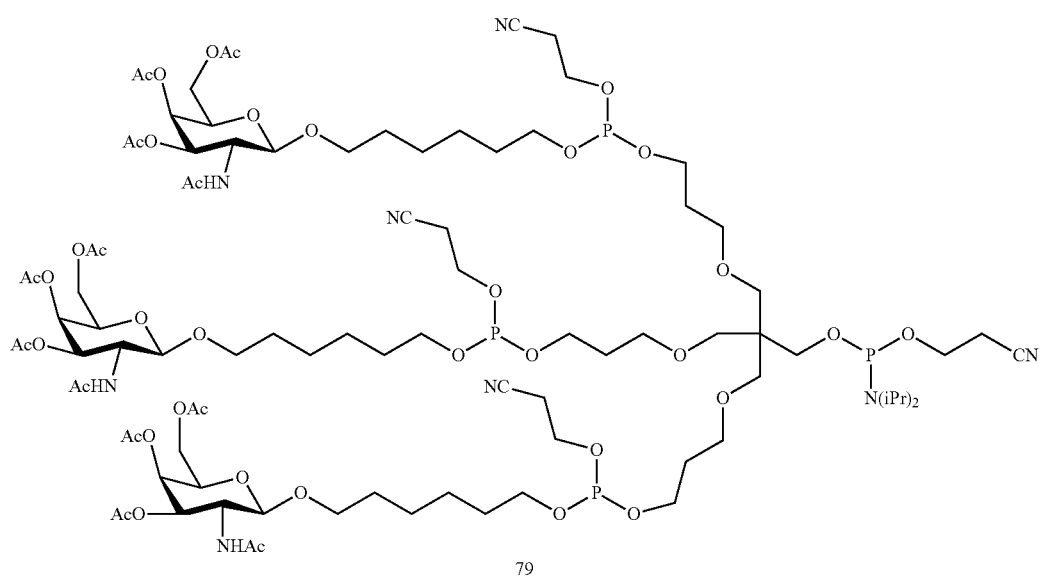
79
Compound 76 was prepared according to published procedures reported by Shchepinov et al., *Nucleic Acids Research*, 1997, 25(22), 4447-4454.
Example 36
Preparation of Compound 79a
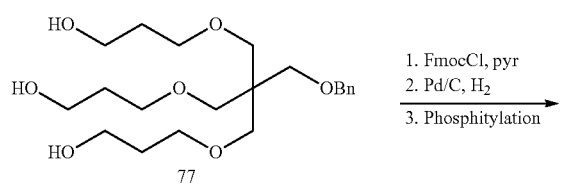
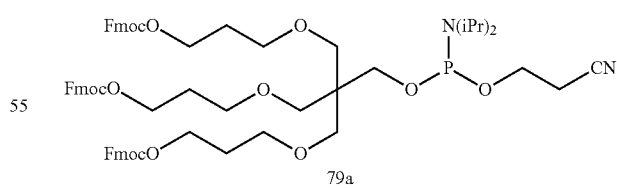
79a
Compound 77 is prepared as per the procedures illustrated in Example 35.

Example 37
General Method for the Preparation of Conjugated Oligomeric Compound 82 Comprising a Phosphodiester Linked GalNAc₃-2 Conjugate at 5′ Terminus Via Solid Support (Method I)
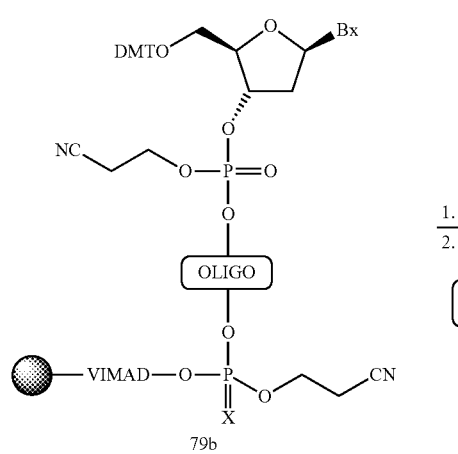
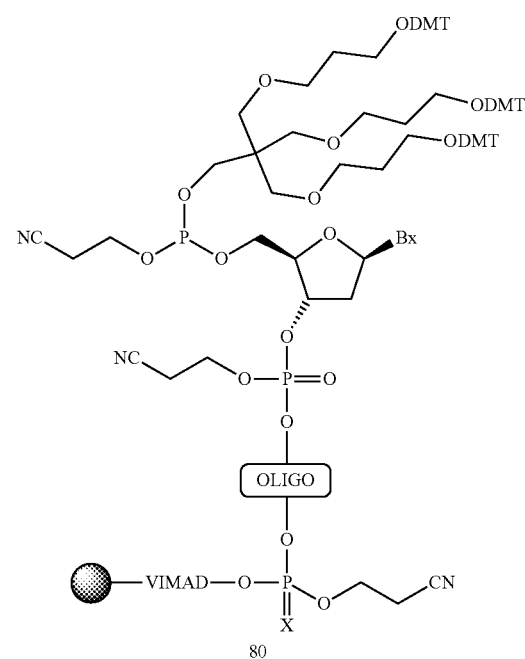
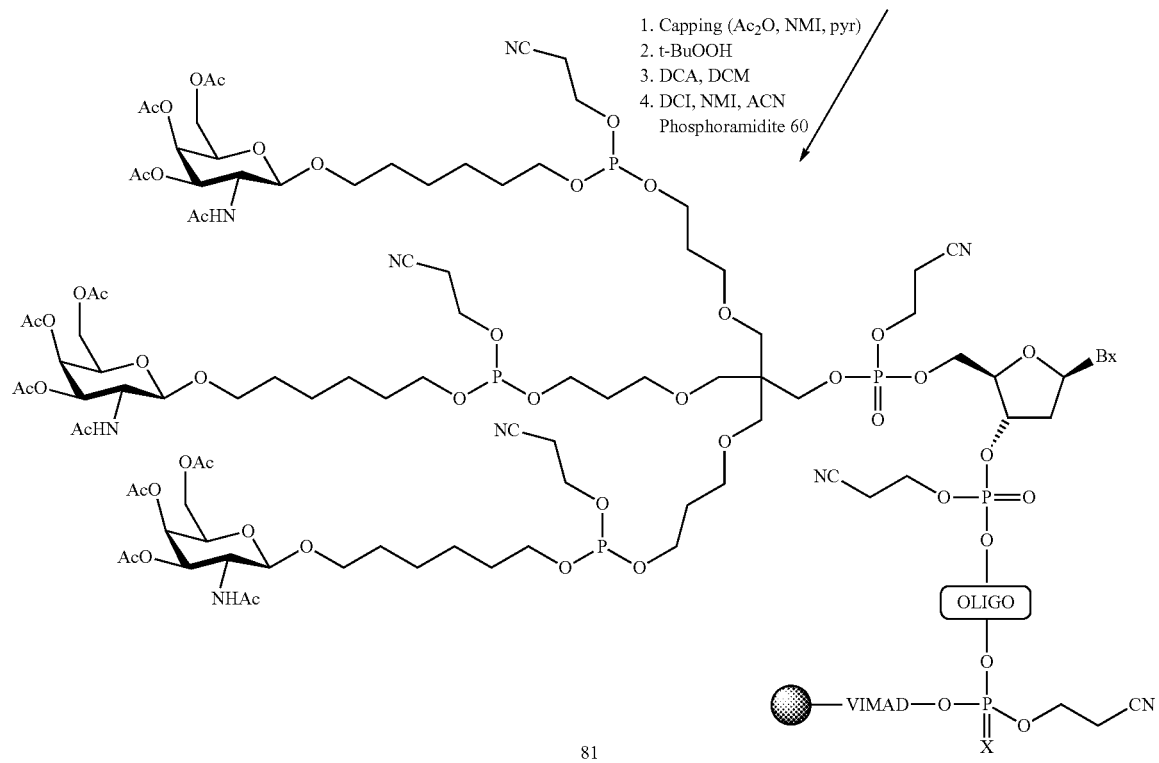

-continued
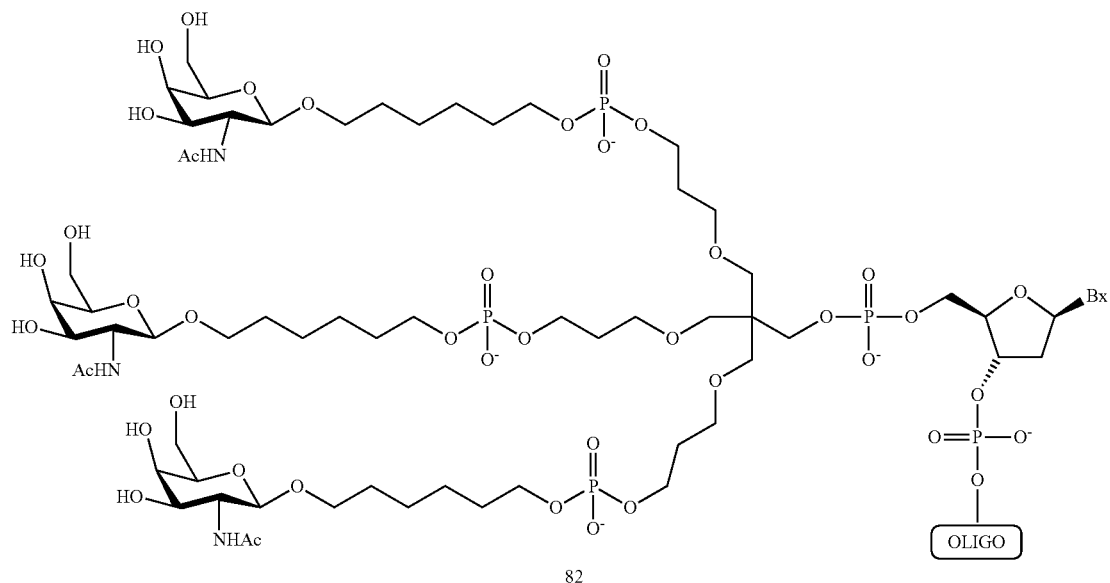
82
wherein GalNAc₃-2 has the structure:
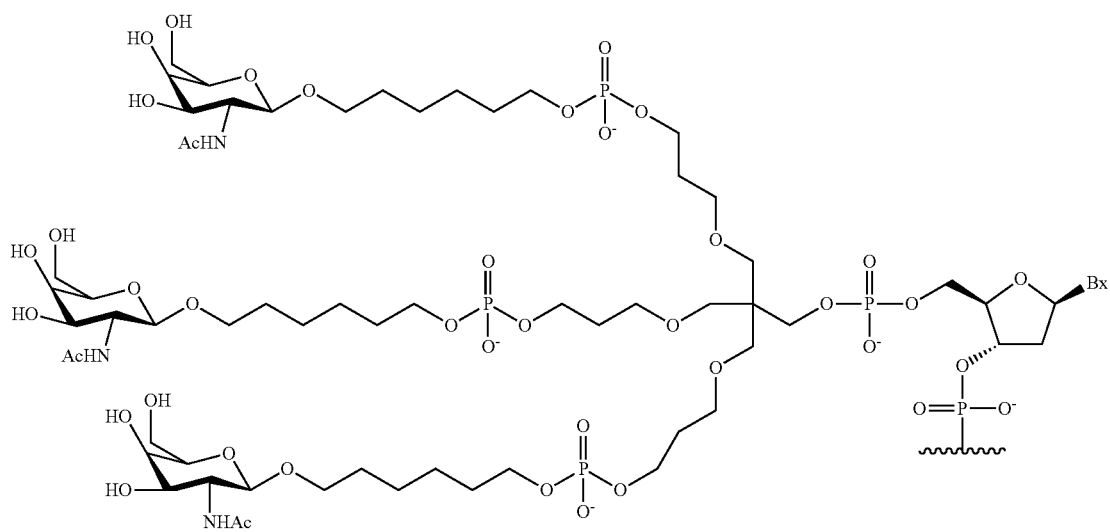
The GalNAc₃ cluster portion of the conjugate group GalNAc₃-2 (GalNAc₃-2$_a$) can be combined with any cleavable moiety to provide a variety of conjugate groups. Wherein GalNAc₃-2$_a$ has the formula:

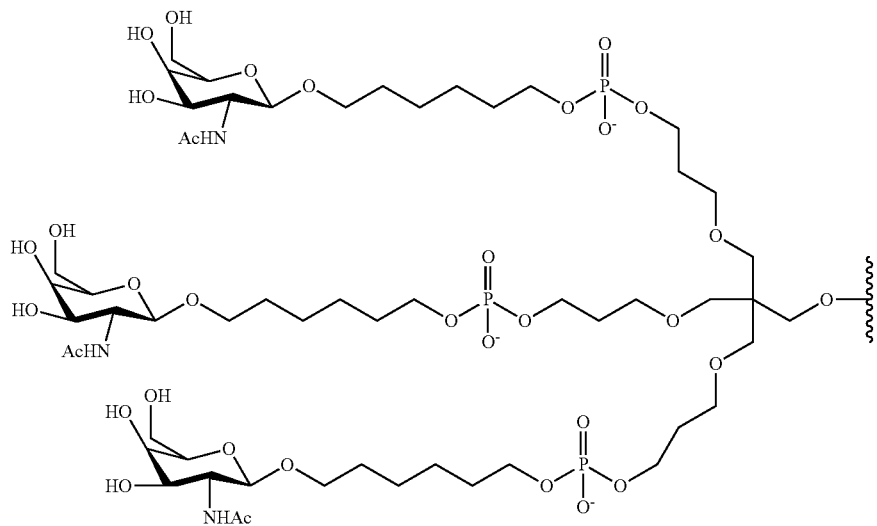

The VIMAD-bound oligomeric compound 79b was prepared using standard procedures for automated DNA/RNA synthesis (see Dupouy et al., *Angew. Chem. Int. Ed.,* 2006, 45, 3623-3627). The phosphoramidite Compounds 56 and 60 were prepared as per the procedures illustrated in Examples 27 and 28, respectively. The phosphoramidites illustrated are meant to be representative and not intended to be limiting as other phosphoramidite building blocks including but not limited those presented in the specification herein can be used to prepare an oligomeric compound having a phosphodiester linked conjugate group at the 5' terminus. The order and quantity of phosphoramidites added to the solid support can be adjusted to prepare the oligomeric compounds as described herein having any predetermined sequence and composition.

Example 38

Alternative Method for the Preparation of Oligomeric Compound 82 Comprising a Phosphodiester Linked GalNAc$_3$-2 Conjugate at 5' Terminus (Method II)

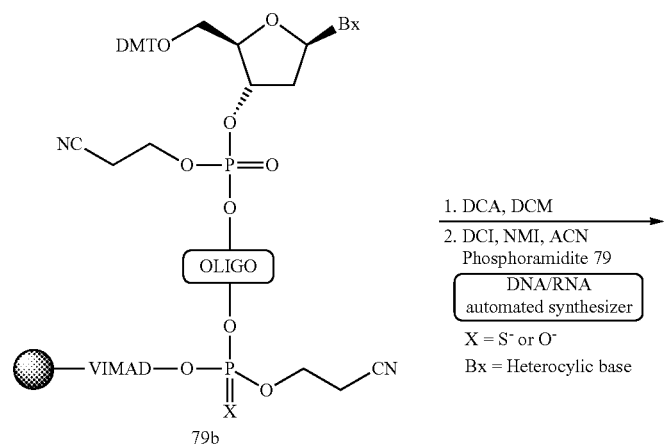

-continued

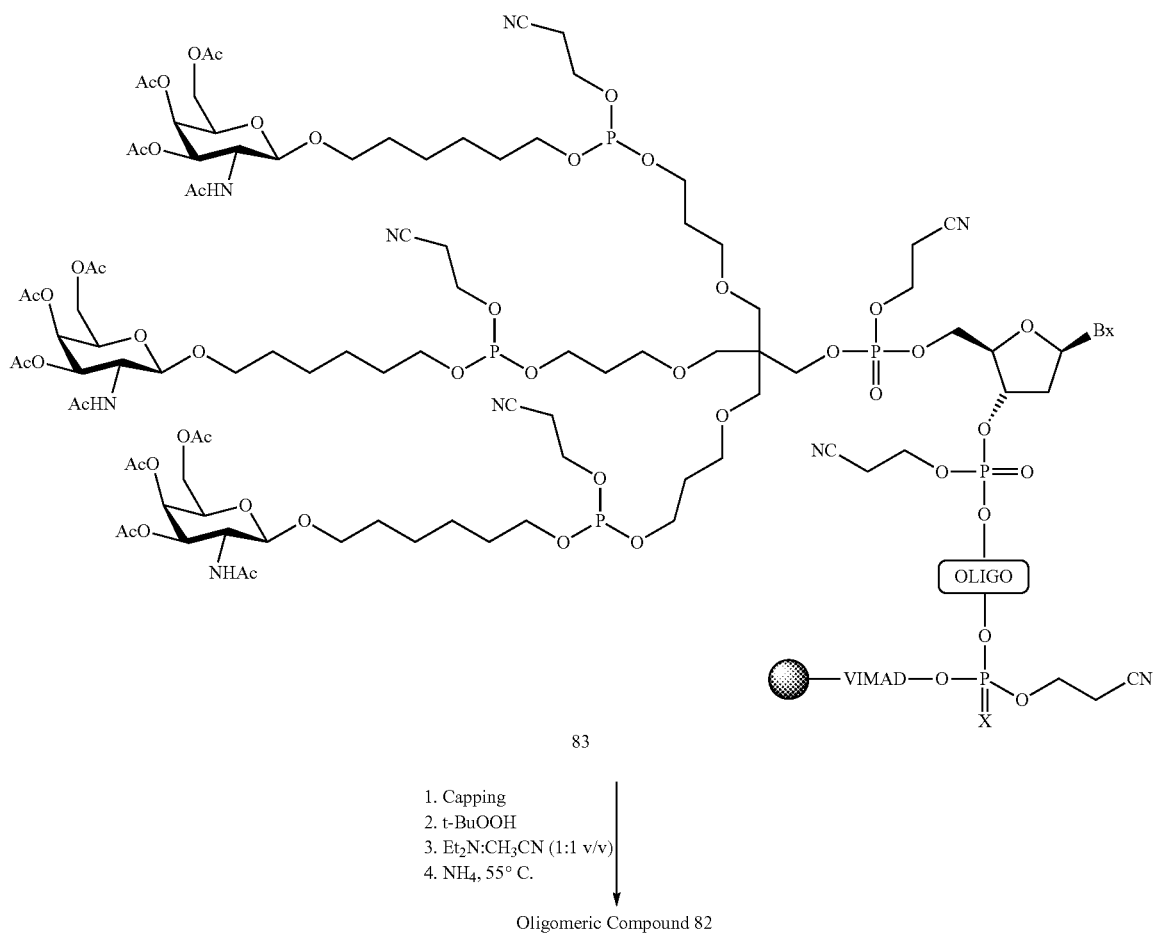

83

1. Capping
2. t-BuOOH
3. Et$_2$N:CH$_3$CN (1:1 v/v)
4. NH$_4$, 55° C.

Oligomeric Compound 82

The VIMAD-bound oligomeric compound 79b was prepared using standard procedures for automated DNA/RNA synthesis (see Dupouy et al., *Angew. Chem. Int. Ed.,* 2006, 45, 3623-3627). The GalNAc$_3$-2 cluster phosphoramidite, Compound 79 was prepared as per the procedures illustrated in Example 35. This alternative method allows a one-step installation of the phosphodiester linked GalNAc$_3$-2 conjugate to the oligomeric compound at the final step of the synthesis. The phosphoramidites illustrated are meant to be representative and not intended to be limiting, as other phosphoramidite building blocks including but not limited to those presented in the specification herein can be used to prepare oligomeric compounds having a phosphodiester conjugate at the 5' terminus. The order and quantity of phosphoramidites added to the solid support can be adjusted to prepare the oligomeric compounds as described herein having any predetermined sequence and composition.

Example 39
General Method for the Preparation of Oligomeric Compound 83h Comprising a GalNAc₃-3 Conjugate at the 5' Terminus (GalNAc₃-1 Modified for 5' End Attachment) Via Solid Support
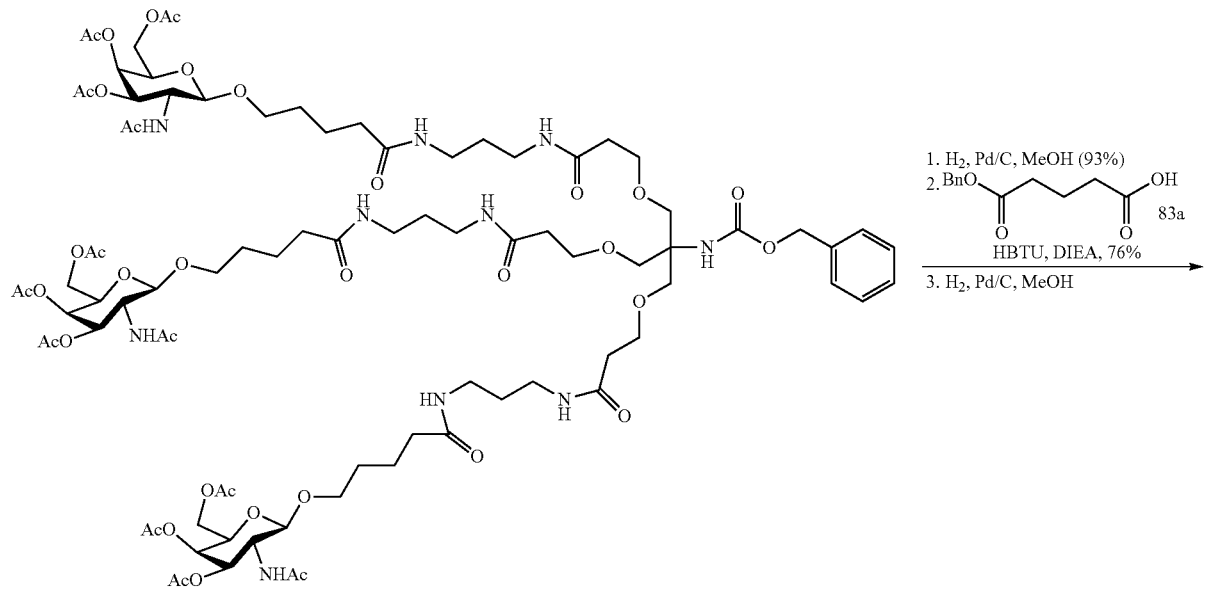
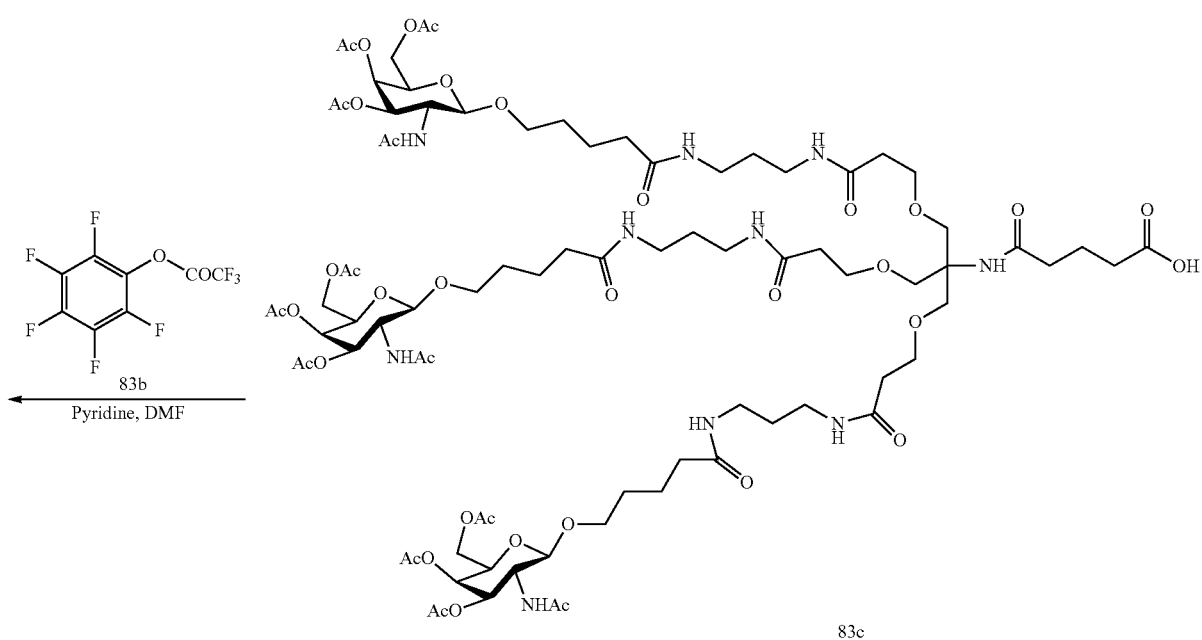

-continued
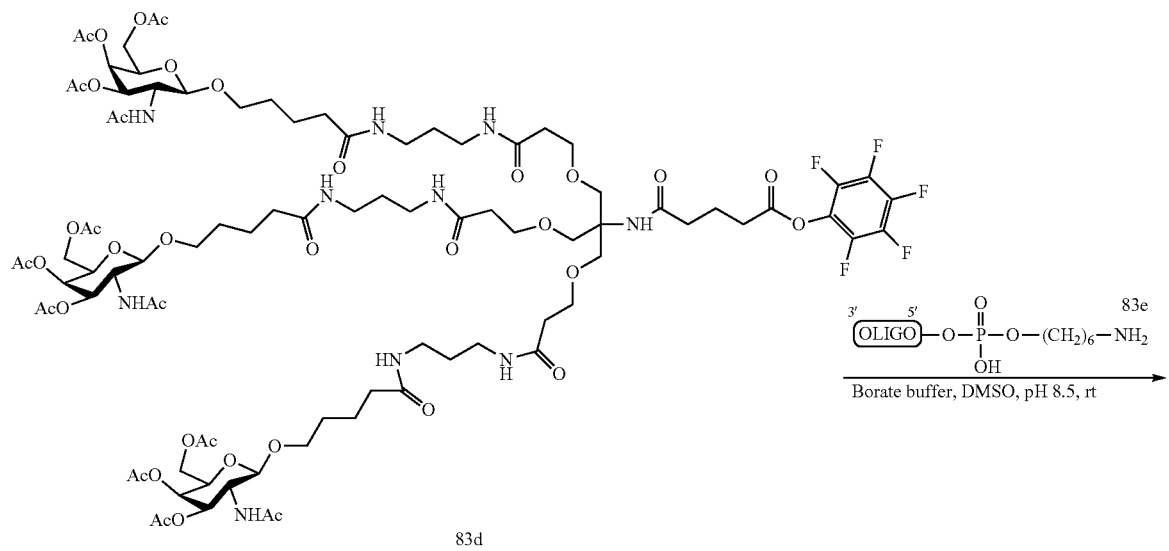
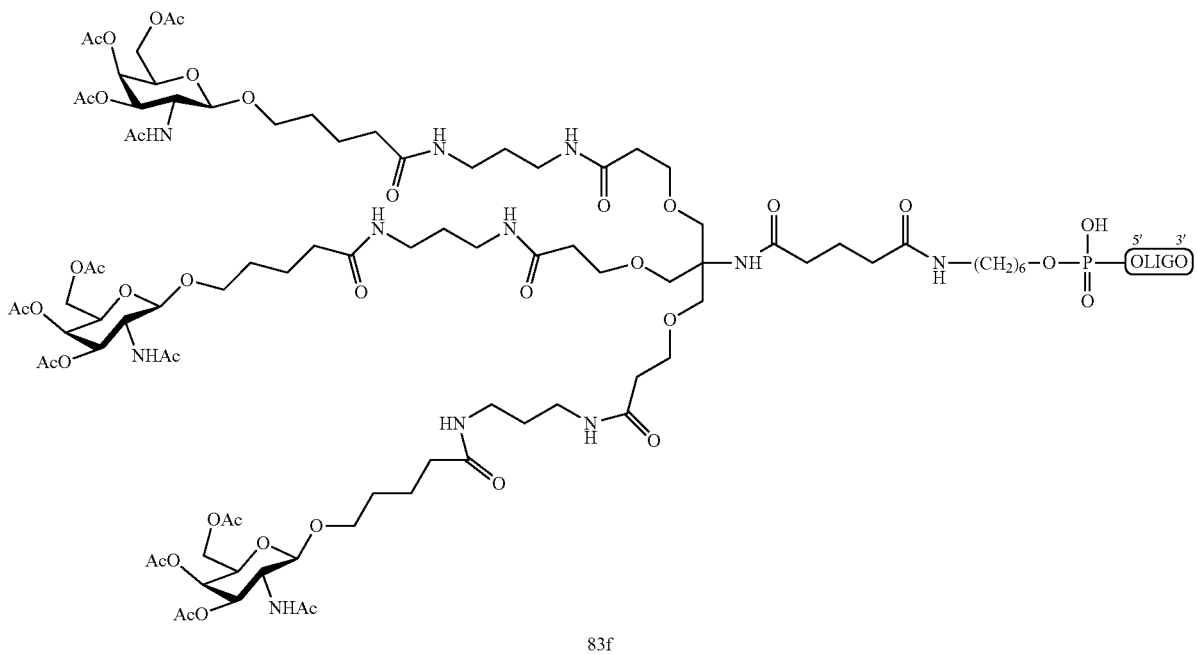
Aqueous ammonia ↓

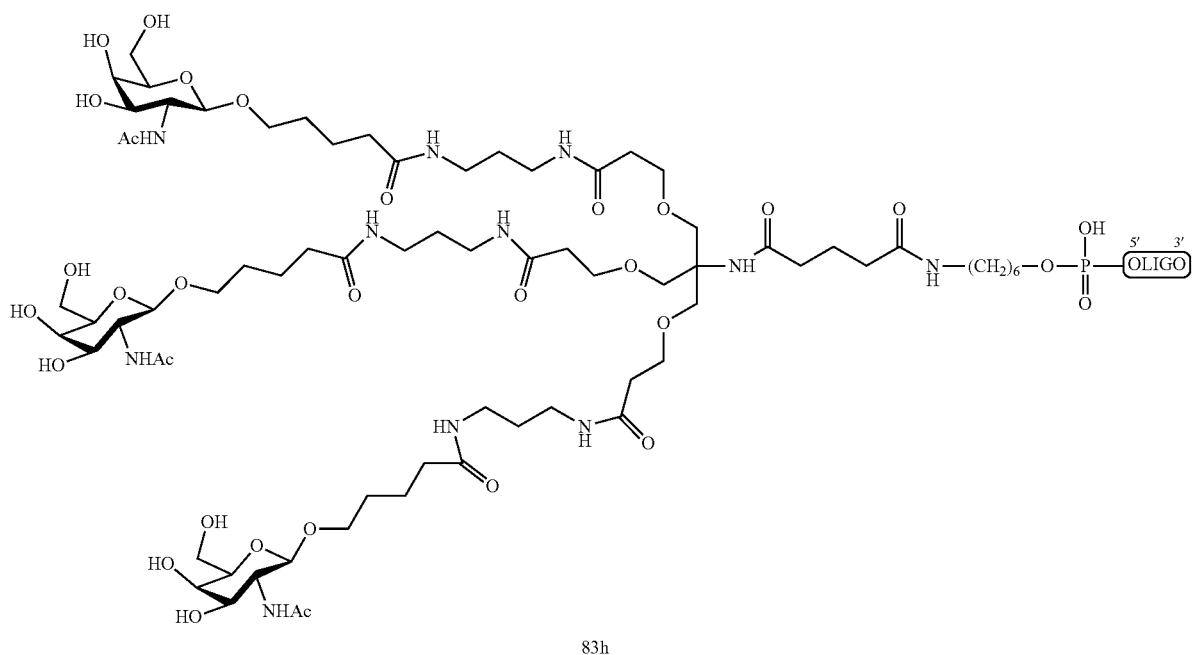

83h

Compound 18 was prepared as per the procedures illustrated in Example 4. Compounds 83a and 83b are commercially available. Oligomeric Compound 83e comprising a phosphodiester linked hexylamine was prepared using standard oligonucleotide synthesis procedures. Treatment of the protected oligomeric compound with aqueous ammonia provided the 5'-GalNAc$_3$-3 conjugated oligomeric compound (83h).

Wherein GalNAc$_3$-3 has the structure:

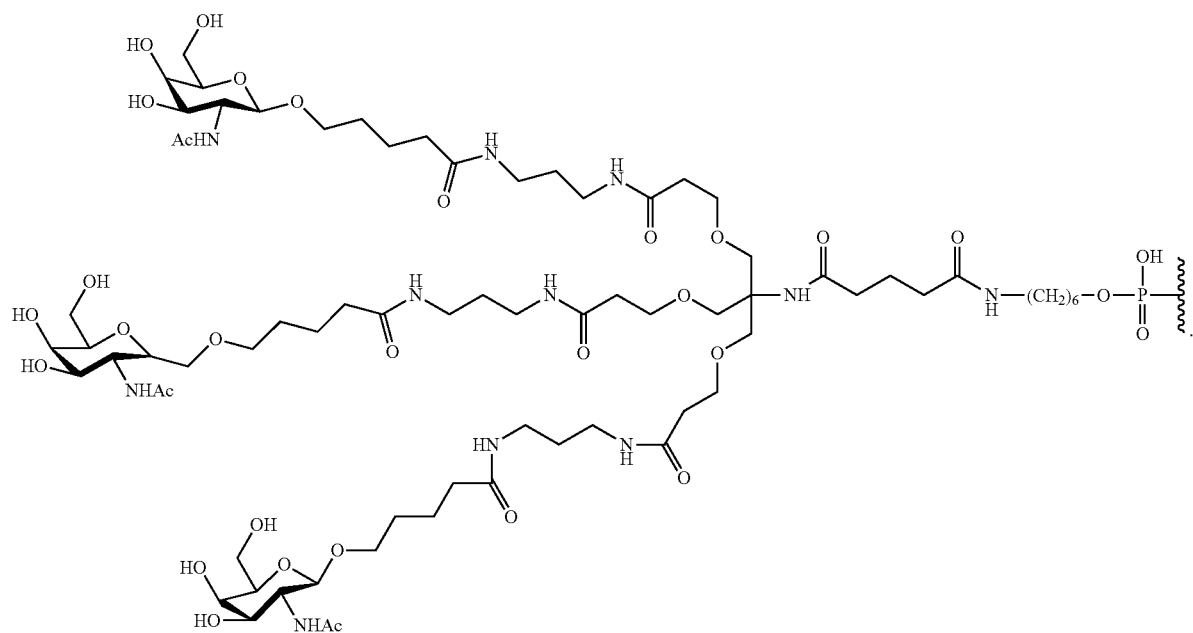

The GalNAc₃ cluster portion of the conjugate group GalNAc₃-3 (GalNAc₃-3$_a$) can be combined with any cleavable moiety to provide a variety of conjugate groups. Wherein GalNAc₃-3$_a$ has the formula:
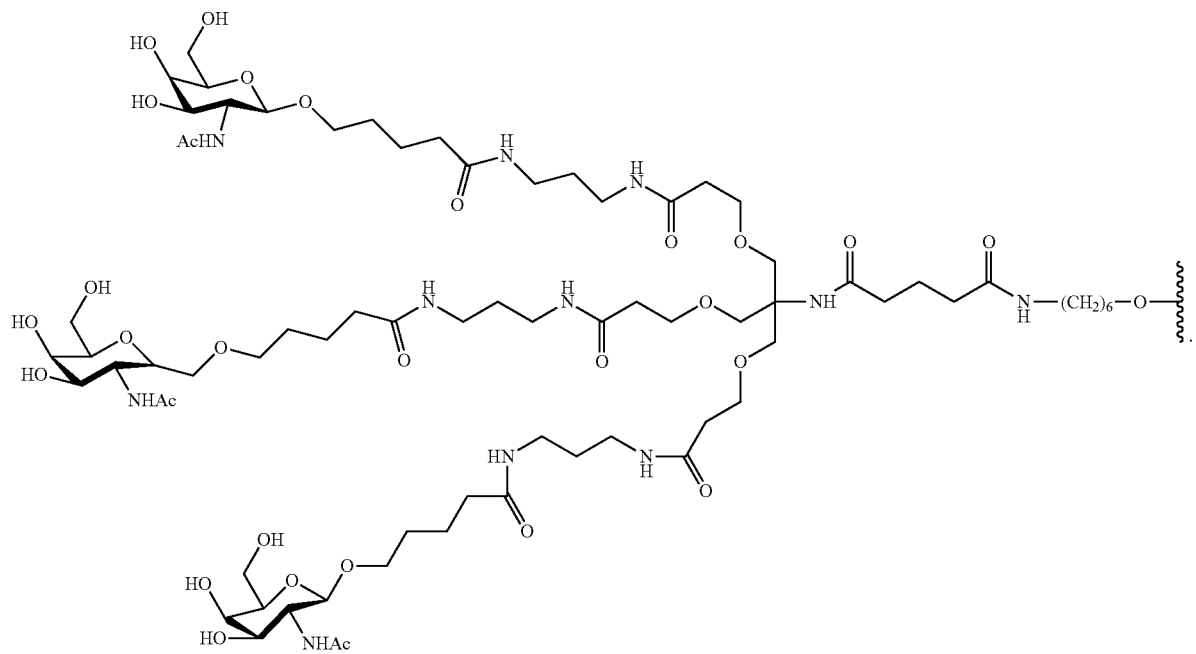
Example 40
General Method for the Preparation of Oligomeric Compound 89 Comprising a Phosphodiester Linked GalNAc₃-4 Conjugate at the 3' Terminus Via Solid Support
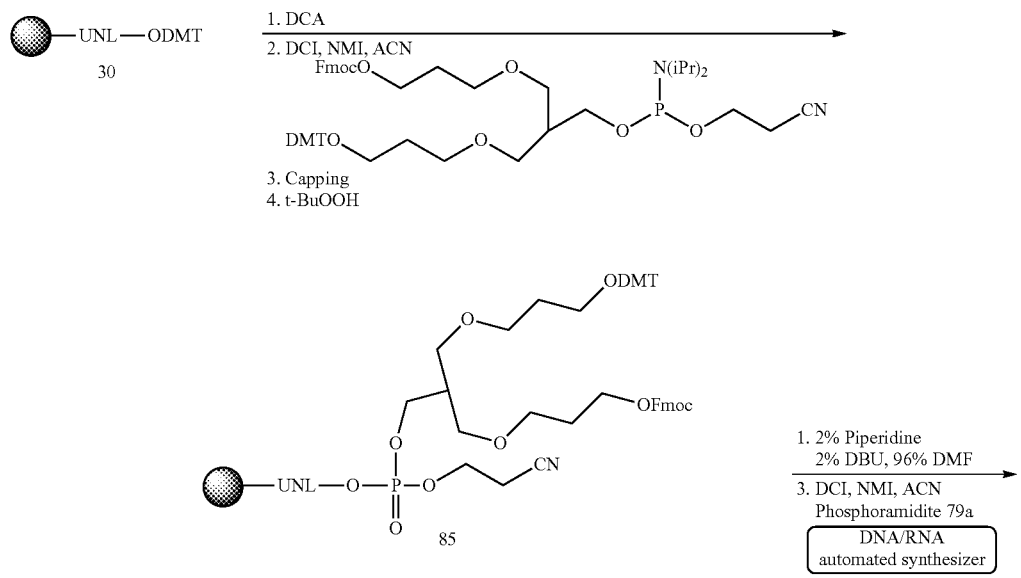

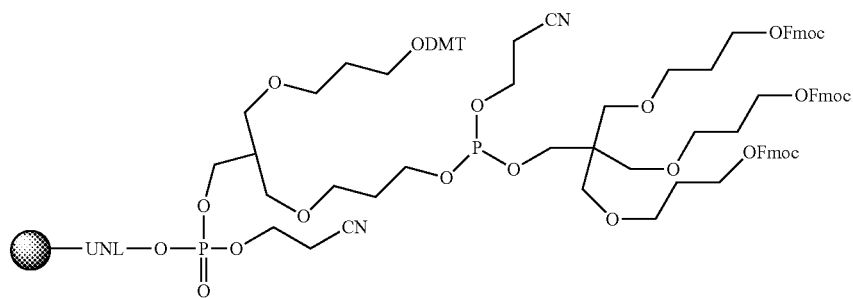
86
1. Capping
2. t-BuOOH
3. 2% Piperidine, 2% DBU, 96% DMF
4. DCI, NMI, ACN
   Phosphoramidite 60
   DNA/RNA automated synthesizer
5. Capping
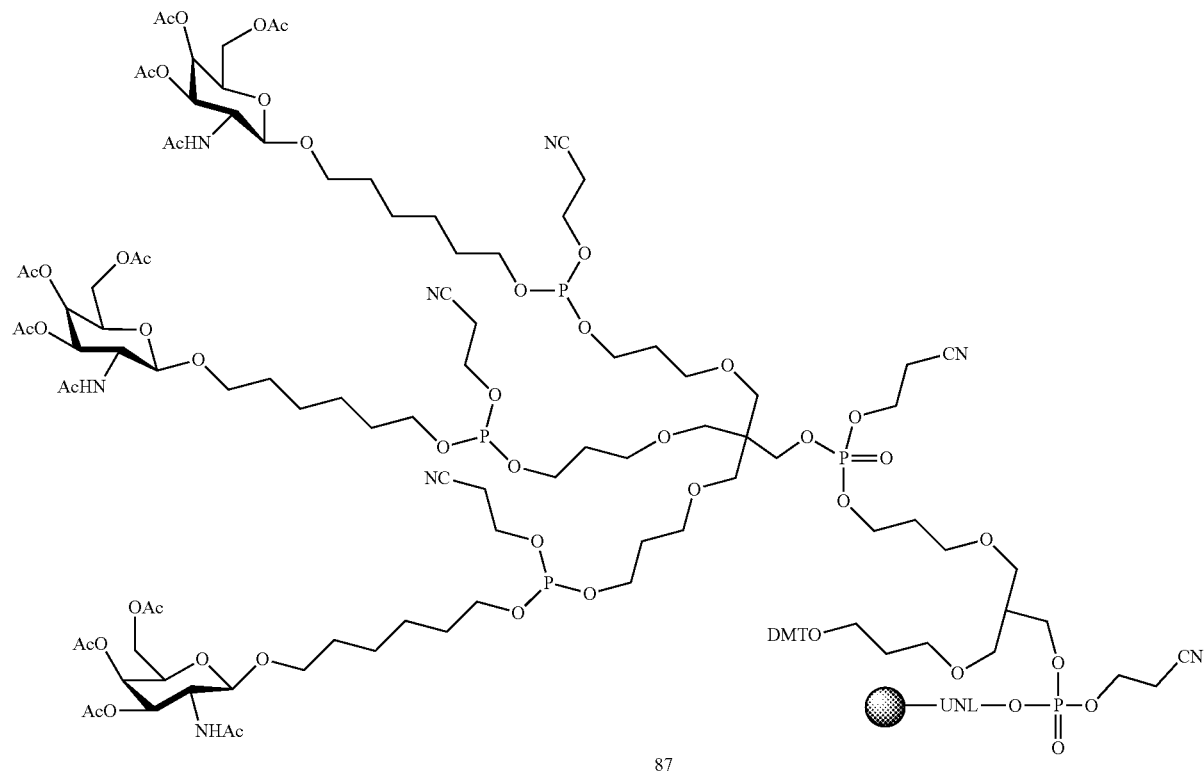
87
1. t-BuOOH
2. DCA
3. Oligo synthesis (DNA/RNA automated synthesizer
4. Capping
5. Oxidation
6. Et$_3$N:CH$_3$CN (1:1, v/v)

-continued
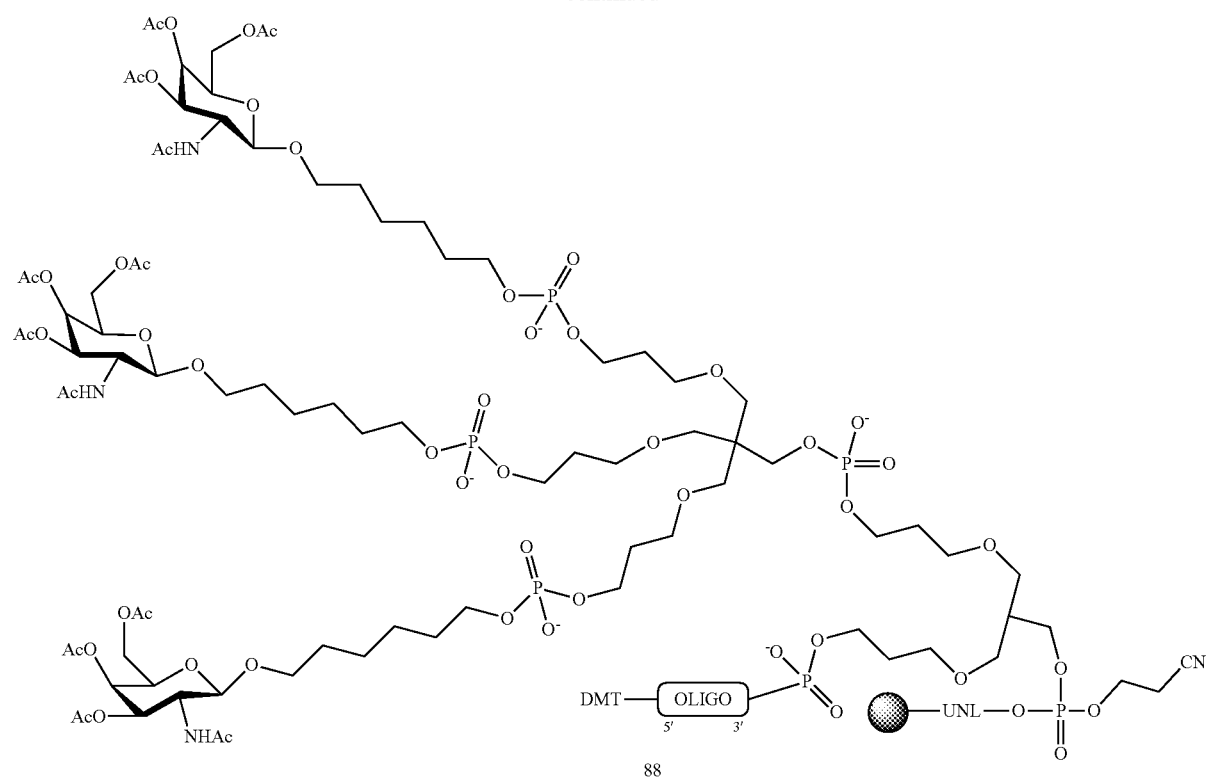
NH₄, 55° C.
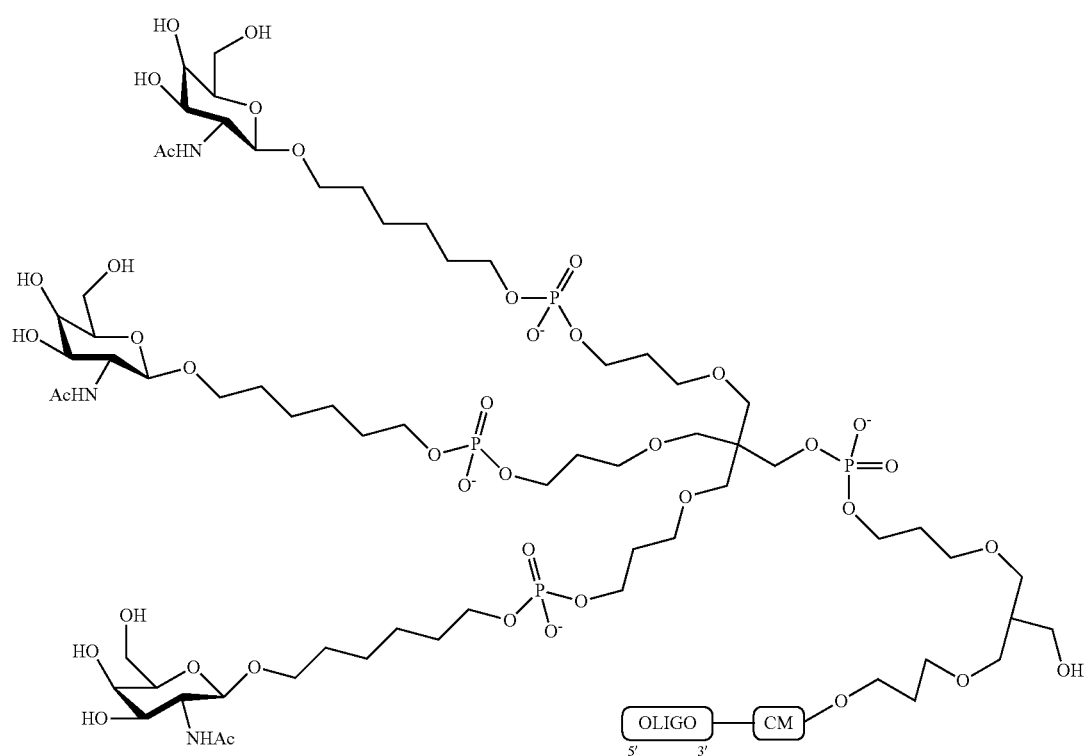

Wherein GalNAc₃-4 has the structure:
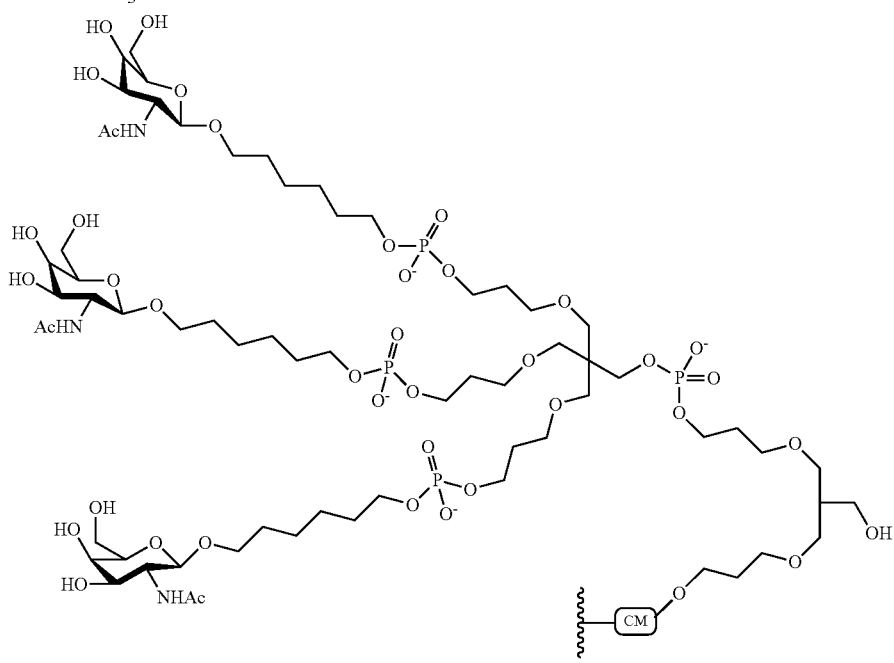
Wherein CM is a cleavable moiety. In certain embodiments, cleavable moiety is:
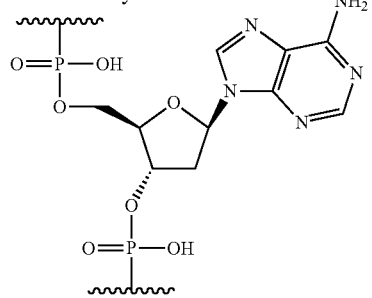
The GalNAc₃ cluster portion of the conjugate group GalNAc₃-4 (GalNAc₃-4$_a$) can be combined with any cleavable moiety to provide a variety of conjugate groups. Wherein GalNAc₃-4$_a$ has the formula:
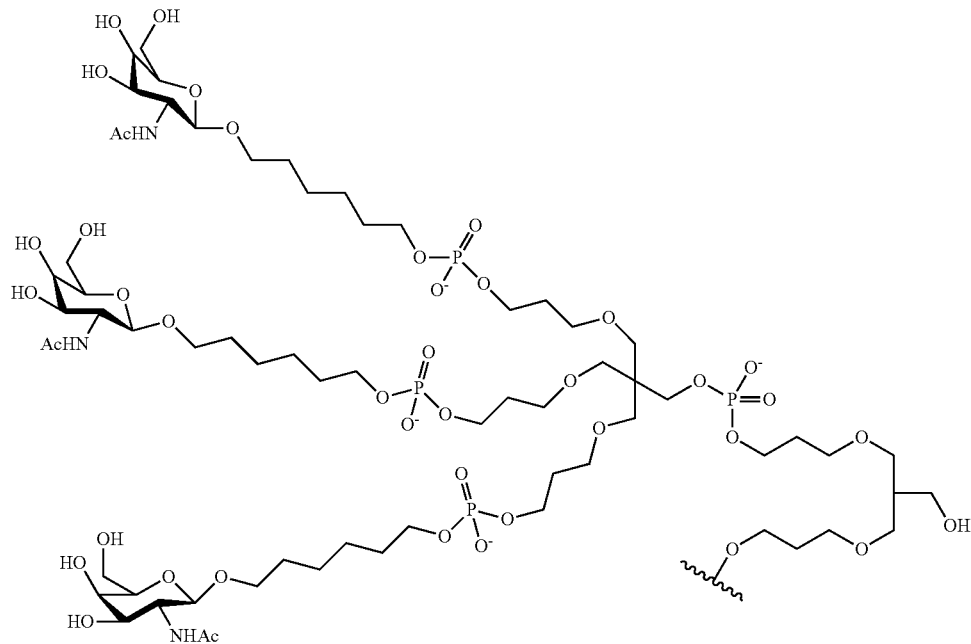

The protected Unylinker functionalized solid support Compound 30 is commercially available. Compound 84 is prepared using procedures similar to those reported in the literature (see Shchepinov et al., *Nucleic Acids Research*, 1997, 25(22), 4447-4454; Shchepinov et al., *Nucleic Acids Research*, 1999, 27, 3035-3041; and Hornet et al., *Nucleic Acids Research*, 1997, 25, 4842-4849).

The phosphoramidite building blocks, Compounds 60 and 79a are prepared as per the procedures illustrated in Examples 28 and 36. The phosphoramidites illustrated are meant to be representative and not intended to be limiting as other phosphoramidite building blocks can be used to prepare an oligomeric compound having a phosphodiester linked conjugate at the 3' terminus with a predetermined sequence and composition. The order and quantity of phosphoramidites added to the solid support can be adjusted to prepare the oligomeric compounds as described herein having any predetermined sequence and composition.

Example 41

General Method for the Preparation of ASOs Comprising a Phosphodiester Linked GalNAc$_3$-2 (See Example 37, Bx is Adenine) Conjugate at the 5' Position Via Solid Phase Techniques (Preparation of ISIS 661134)

Unless otherwise stated, all reagents and solutions used for the synthesis of oligomeric compounds are purchased from commercial sources. Standard phosphoramidite building blocks and solid support are used for incorporation nucleoside residues which include for example T, A, G, and $^m$C residues. Phosphoramidite compounds 56 and 60 were used to synthesize the phosphodiester linked GalNAc$_3$-2 conjugate at the 5' terminus. A 0.1 M solution of phosphoramidite in anhydrous acetonitrile was used for (3-D-2'-deoxyribonucleoside and 2'-MOE.

The ASO syntheses were performed on ABI 394 synthesizer (1-2 μmol scale) or on GE Healthcare Bioscience ÄKTA oligopilot synthesizer (40-200 μmol scale) by the phosphoramidite coupling method on VIMAD solid support (110 μmol/g, Guzaev et al., 2003) packed in the column. For the coupling step, the phosphoramidites were delivered at a 4 fold excess over the initial loading of the solid support and phosphoramidite coupling was carried out for 10 min. All other steps followed standard protocols supplied by the manufacturer. A solution of 6% dichloroacetic acid in toluene was used for removing the dimethoxytrityl (DMT) groups from 5'-hydroxyl groups of the nucleotide. 4,5-Dicyanoimidazole (0.7 M) in anhydrous CH$_3$CN was used as activator during the coupling step. Phosphorothioate linkages were introduced by sulfurization with 0.1 M solution of xanthane hydride in 1:1 pyridine/CH$_3$CN for a contact time of 3 minutes. A solution of 20% tert-butylhydroperoxide in CH$_3$CN containing 6% water was used as an oxidizing agent to provide phosphodiester internucleoside linkages with a contact time of 12 minutes.

After the desired sequence was assembled, the cyanoethyl phosphate protecting groups were deprotected using a 20% diethylamine in toluene (v/v) with a contact time of 45 minutes. The solid-support bound ASOs were suspended in aqueous ammonia (28-30 wt %) and heated at 55° C. for 6 h. The unbound ASOs were then filtered and the ammonia was boiled off. The residue was purified by high pressure liquid chromatography on a strong anion exchange column (GE Healthcare Bioscience, Source 30Q, 30 μm, 2.54×8 cm, A=100 mM ammonium acetate in 30% aqueous CH$_3$CN, B=1.5 M NaBr in A, 0-40% of B in 60 min, flow 14 mL min-1, λ=260 nm). The residue was desalted by HPLC on a reverse phase column to yield the desired ASOs in an isolated yield of 15-30% based on the initial loading on the solid support. The ASOs were characterized by ion-pair-HPLC coupled MS analysis with Agilent 1100 MSD system.

TABLE 34

ASO comprising a phosphodiester linked GalNAc$_3$-2 conjugate at the 5' position targeting SRB-1

| ISIS No. | Sequence (5' to 3') | CalCd Mass | Observed Mass | SEQ ID No. |
|---|---|---|---|---|
| 661134 | GalNAc$_3$-2$_{a'-o'}$A$_{do}$T$_{ks}$$^m$C$_{ks}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{ks}$$^m$C$_k$ | 6482.2 | 6481.6 | 4884 |

Subscripts: "e" indicates 2'-MOE modified nucleoside; "d" indicates β-D-2'-deoxyribonucleoside; "k" indicates 6'-(S)—CH$_3$ bicyclic nucleoside (e.g. cEt); "s" indicates phosphorothioate internucleoside linkages (PS); "o" indicates phosphodiester internucleoside linkages (PO); and "o'" indicates —O—P(=O)(OH)—. Superscript "m" indicates 5-methylcytosines. The structure of GalNAc$_3$-2$_a$ is shown in Example 37.

Example 42

General Method for the Preparation of ASOs Comprising a GalNAc$_3$-3 Conjugate at the 5' Position Via Solid Phase Techniques (Preparation of ISIS 661166)

The synthesis for ISIS 661166 was performed using similar procedures as illustrated in Examples 39 and 41.

ISIS 661166 is a 5-10-5 MOE gapmer, wherein the 5' position comprises a GalNAc$_3$-3 conjugate. The ASO was characterized by ion-pair-HPLC coupled MS analysis with Agilent 1100 MSD system.

TABLE 34a

ASO comprising a GalNAc$_3$-3 conjugate at the 5' position
via a hexylamino phosphodiester linkage targeting Malat-1

| ISIS No. | Sequence (5' to 3') | Conjugate | Calcd Mass | Observed Mass | SEQ ID No. |
|---|---|---|---|---|---|
| 661166 | 5'-GalNAc$_3$-3$_{a\text{-}o}$,$^m$C$_{es}$G$_{es}$G$_{es}$T$_{es}$G$_{es}$ $^m$C$_{ds}$A$_{ds}$A$_{ds}$G$_{ds}$G$_{ds}$$^m$C$_{ds}$T$_{ds}$T$_{ds}$A$_{ds}$G$_{ds}$ G$_{es}$A$_{es}$A$_{es}$T$_{es}$T$_e$ | 5'-GalNAc$_3$-3 | 8992.16 | 8990.51 | 4885 |

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o'" indicates —O—P(═O)(OH)—. Superscript "m" indicates 5-methylcytosines. The structure of "5'-GalNAc$_3$-3a" is shown in Example 39.

Example 43

Dose-Dependent Study of Phosphodiester Linked GalNAc$_3$-2 (See Examples 37 and 41, Bx is Adenine) at the 5' Terminus Targeting SRB-1 In Vivo ISIS 661134 (see Example 41) comprising a phosphodiester linked GalNAc$_3$-2 conjugate at the 5' terminus was tested in a dose-dependent study for antisense inhibition of SRB-1 in mice. Unconjugated ISIS 440762 and 651900 (GalNAc$_3$-1 conjugate at 3' terminus, see Example 9) were included in the study for comparison and are described previously in Table 17.

Treatment Six week old male Balb/c mice (Jackson Laboratory, Bar Harbor, Me.) were injected subcutaneously once at the dosage shown below with ISIS 440762, 651900, 661134 or with PBS treated control. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are presented below.

As illustrated in Table 35, treatment with antisense oligonucleotides lowered SRB-1 mRNA levels in a dose-dependent manner. Indeed, the antisense oligonucleotides comprising the phosphodiester linked GalNAc$_3$-2 conjugate at the 5' terminus (ISIS 661134) or the GalNAc$_3$-1 conjugate linked at the 3' terminus (ISIS 651900) showed substantial improvement in potency compared to the unconjugated antisense oligonucleotide (ISIS 440762). Further, ISIS 661134, which comprises the phosphodiester linked GalNAc$_3$-2 conjugate at the 5' terminus was equipotent compared to ISIS 651900, which comprises the GalNAc$_3$-1 conjugate at the 3' terminus.

TABLE 35

ASOs containing GalNAc$_3$-1 or GalNAc$_3$-2 targeting SRB-1

| ISIS No. | Dosage (mg/kg) | SRB-1 mRNA levels (% PBS) | ED$_{50}$ (mg/kg) | Conjugate | SEQ ID No |
|---|---|---|---|---|---|
| PBS | 0 | 100 | — | — | |
| 440762 | 0.2 | 116 | 2.58 | No conjugate | 4880 |
|  | 0.7 | 91 | | | |
|  | 2 | 69 | | | |
|  | 7 | 22 | | | |
|  | 20 | 5 | | | |
| 651900 | 0.07 | 95 | 0.26 | 3' GalNAc$_3$-1 | 4881 |
|  | 0.2 | 77 | | | |
|  | 0.7 | 28 | | | |
|  | 2 | 11 | | | |
|  | 7 | 8 | | | |
| 661134 | 0.07 | 107 | 0.25 | 5' GalNAc$_3$-2 | 4881 |
|  | 0.2 | 86 | | | |
|  | 0.7 | 28 | | | |
|  | 2 | 10 | | | |
|  | 7 | 6 | | | |

Structures for 3' GalNAc$_3$-1 and 5' GalNAc$_3$-2 were described previously in Examples 9 and 37.

Pharmacokinetics Analysis (PK)

The PK of the ASOs from the high dose group (7 mg/kg) was examined and evaluated in the same manner as illustrated in Example 20. Liver sample was minced and extracted using standard protocols. The full length metabolites of 661134 (5' GalNAc$_3$-2) and ISIS 651900 (3' GalNAc$_3$-1) were identified and their masses were confirmed by high resolution mass spectrometry analysis. The results showed that the major metabolite detected for the ASO comprising a phosphodiester linked GalNAc$_3$-2 conjugate at the 5' terminus (ISIS 661134) was ISIS 440762 (data not shown). No additional metabolites, at a detectable level, were observed. Unlike its counterpart, additional metabolites similar to those reported previously in Table 23a were observed for the ASO having the GalNAc$_3$-1 conjugate at the 3' terminus (ISIS 651900). These results suggest that having the phosphodiester linked GalNAc$_3$-1 or GalNAc$_3$-2 conjugate may improve the PK profile of ASOs without compromising their potency.

Example 44

Effect of PO/PS Linkages on Antisense Inhibition of ASOs Comprising GalNAc$_3$-1 Conjugate (See Example 9) at the 3' Terminus Targeting SRB-1

ISIS 655861 and 655862 comprising a GalNAc$_3$-1 conjugate at the 3' terminus each targeting SRB-1 were tested in a single administration study for their ability to inhibit SRB-1 in mice. The parent unconjugated compound, ISIS 353382 was included in the study for comparison.

The ASOs are 5-10-5 MOE gapmers, wherein the gap region comprises ten 2'-deoxyribonucleosides and each wing region comprises five 2'-MOE modified nucleosides. The ASOs were prepared using similar methods as illustrated previously in Example 19 and are described Table 36, below.

TABLE 36

Modified ASOs comprising GalNAc$_3$-1 conjugate at the 3' terminus targeting SRB-1

| ISIS No. | Sequence (5' to 3') | Chemistry | SEQ ID No. |
|---|---|---|---|
| 353382 (parent) | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{e}$ | Full PS no conjugate | 4886 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{es}$$^m$C$_{es}$$^m$C$_{es}$T$_{es}$T$_{eo}$A$_{do}$-GalNAc$_3$-1$_a$ | Full PS with GalNAc$_3$-1 conjugate | 4887 |
| 655862 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$ $^m$C$_{ds}$T$_{ds}$T$_{eo}$$^m$C$_{eo}$$^m$C$_{es}$T$_{es}$T$_{eo}$A$_{do'}$-GalNAc$_3$-1$_a$ | Mixed PS/PO with GalNAc$_3$-1 conjugate | 4887 |

Subscripts: "e" indicates 2'-MOE modified nucleoside; "d" indicates β-D-2'-deoxyribonucleoside; "s" indicates phosphorothioate internucleoside linkages (PS); "o" indicates phosphodiester internucleoside linkages (PO); and "o'" indicates —O—P(═O)(OH)—. Superscript "m" indicates 5-methylcytosines. The structure of "GalNAc$_3$-1" is shown in Example 9.

Treatment

Six week old male Balb/c mice (Jackson Laboratory, Bar Harbor, Me.) were injected subcutaneously once at the dosage shown below with ISIS 353382, 655861, 655862 or with PBS treated control. Each treatment group consisted of 4 animals. Prior to the treatment as well as after the last dose, blood was drawn from each mouse and plasma samples were analyzed. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are reported below.

As illustrated in Table 37, treatment with antisense oligonucleotides lowered SRB-1 mRNA levels in a dose-dependent manner compared to PBS treated control. Indeed, the antisense oligonucleotides comprising the GalNAc$_3$-1 conjugate at the 3' terminus (ISIS 655861 and 655862) showed substantial improvement in potency comparing to the unconjugated antisense oligonucleotide (ISIS 353382). Further, ISIS 655862 with mixed PS/PO linkages showed an improvement in potency relative to full PS (ISIS 655861).

TABLE 37

Effect of PO/PS linkages on antisense inhibition of ASOs comprising GalNAc$_3$-1 conjugate at 3' terminus targeting SRB-1

| ISIS No. | Dosage (mg/kg) | SRB-1 mRNA levels (% PBS) | ED$_{50}$ (mg/kg) | Chemistry | SEQ ID No. |
|---|---|---|---|---|---|
| PBS | 0 | 100 | — | — | |
| 353382 (parent) | 3 | 76.65 | 10.4 | Full PS without conjugate | 4886 |
| | 10 | 52.40 | | | |
| | 30 | 24.95 | | | |
| 655861 | 0.5 | 81.22 | 2.2 | Full PS with GalNAc$_3$-1 conjugate | 4887 |
| | 1.5 | 63.51 | | | |
| | 5 | 24.61 | | | |
| | 15 | 14.80 | | | |
| 655862 | 0.5 | 69.57 | 1.3 | Mixed PS/PO with GalNAc$_3$-1 conjugate | 4887 |
| | 1.5 | 45.78 | | | |
| | 5 | 19.70 | | | |
| | 15 | 12.90 | | | |

Liver transaminase levels, alanine aminotransferase (ALT) and aspartate aminotransferase (AST), in serum were measured relative to saline injected mice using standard protocols. Organ weights were also evaluated. The results demonstrated that no elevation in transaminase levels (Table 38) or organ weights (data not shown) were observed in mice treated with ASOs compared to PBS control. Further, the ASO with mixed PS/PO linkages (ISIS 655862) showed similar transaminase levels compared to full PS (ISIS 655861).

TABLE 38

Effect of PO/PS linkages on transaminase levels of ASOs comprising GalNAc$_3$-1 conjugate at 3' terminus targeting SRB-1

| ISIS No. | Dosage (mg/kg) | ALT (U/L) | AST (U/L) | Chemistry | SEQ ID No. |
|---|---|---|---|---|---|
| PBS | 0 | 28.5 | 65 | — | |
| 353382 (parent) | 3 | 50.25 | 89 | Full PS without conjugate | 4886 |
| | 10 | 27.5 | 79.3 | | |
| | 30 | 27.3 | 97 | | |
| 655861 | 0.5 | 28 | 55.7 | Full PS with GalNAc$_3$-1 | 4887 |
| | 1.5 | 30 | 78 | | |
| | 5 | 29 | 63.5 | | |
| | 15 | 28.8 | 67.8 | | |
| 655862 | 0.5 | 50 | 75.5 | Mixed PS/PO with GalNAc$_3$-1 | 4887 |
| | 1.5 | 21.7 | 58.5 | | |
| | 5 | 29.3 | 69 | | |
| | 15 | 22 | 61 | | |

Example 45
Preparation of PFP Ester, Compound 110a
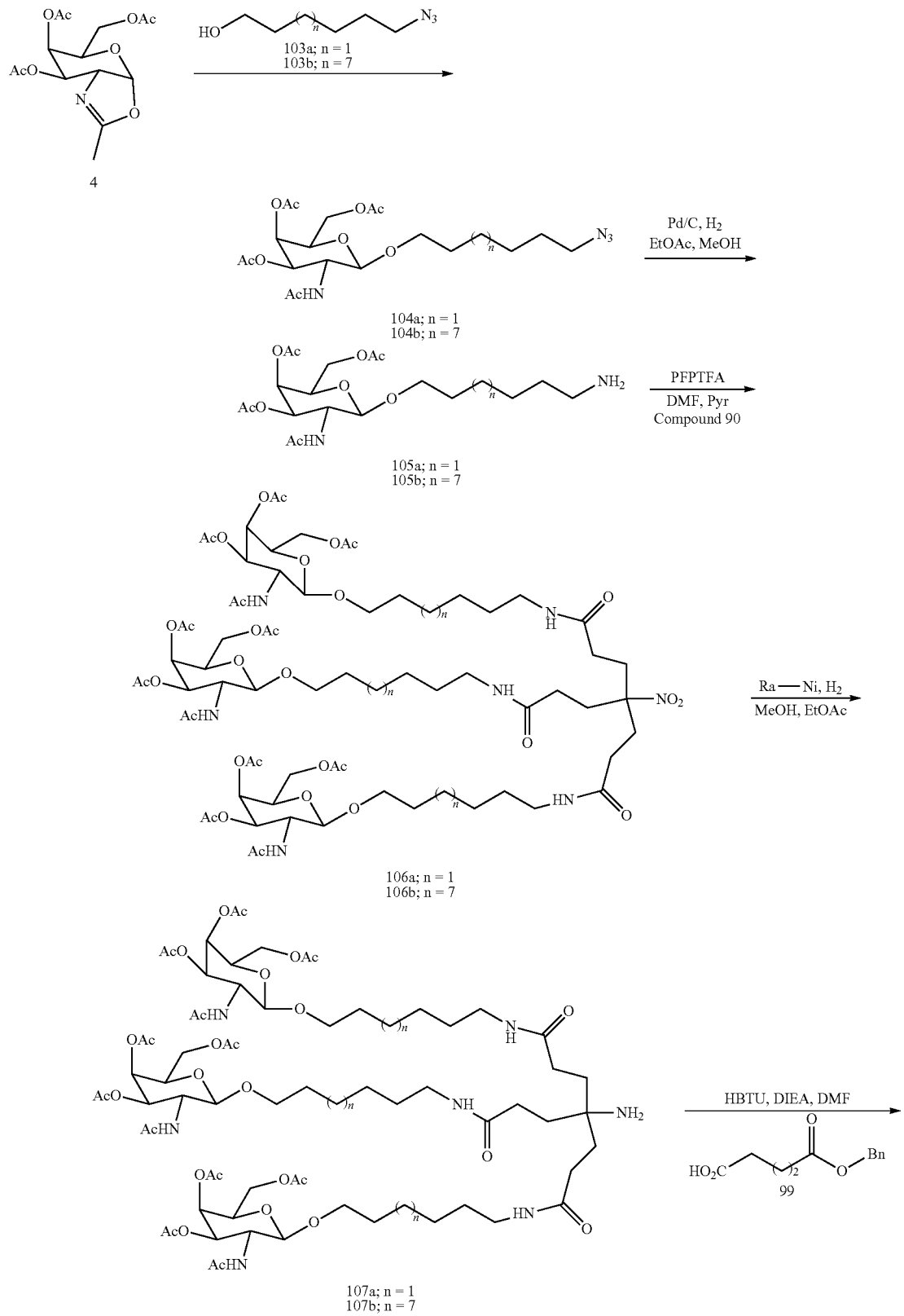

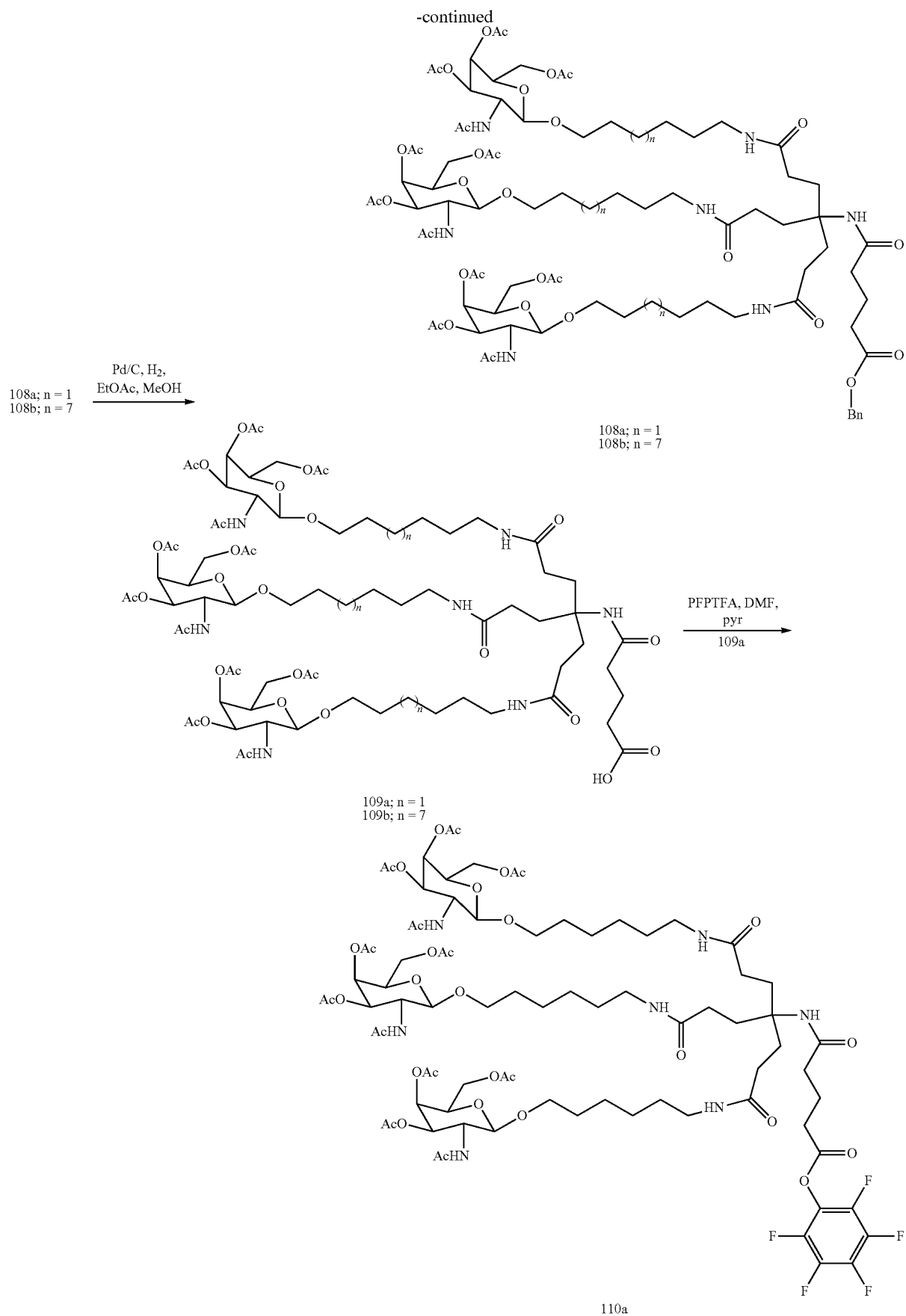

Compound 4 (9.5 g, 28.8 mmoles) was treated with compound 103a or 103b (38 mmoles), individually, and TMSOTf (0.5 eq.) and molecular sieves in dichloromethane (200 mL), and stirred for 16 hours at room temperature. At that time, the organic layer was filtered thru celite, then washed with sodium bicarbonate, water and brine. The organic layer was then separated and dried over sodium sulfate, filtered and reduced under reduced pressure. The resultant oil was purified by silica gel chromatography (2%→10% methanol/dichloromethane) to give compounds 104a and 104b in >80% yield. LCMS and proton NMR was consistent with the structure.

Compounds 104a and 104b were treated to the same conditions as for compounds 100a-d (Example 47), to give compounds 105a and 105b in >90% yield. LCMS and proton NMR was consistent with the structure.

Compounds 105a and 105b were treated, individually, with compound 90 under the same conditions as for compounds 901a-d, to give compounds 106a (80%) and 106b (20%). LCMS and proton NMR was consistent with the structure.

Compounds 106a and 106b were treated to the same conditions as for compounds 96a-d (Example 47), to give 107a (60%) and 107b (20%). LCMS and proton NMR was consistent with the structure.

Compounds 107a and 107b were treated to the same conditions as for compounds 97a-d (Example 47), to give compounds 108a and 108b in 40-60% yield. LCMS and proton NMR was consistent with the structure.

Compounds 108a (60%) and 108b (40%) were treated to the same conditions as for compounds 100a-d (Example 47), to give compounds 109a and 109b in >80% yields. LCMS and proton NMR was consistent with the structure.

Compound 109a was treated to the same conditions as for compounds 101a-d (Example 47), to give Compound 110a in 30-60% yield. LCMS and proton NMR was consistent with the structure. Alternatively, Compound 110b can be prepared in a similar manner starting with Compound 109b.

Example 46

General Procedure for Conjugation with PFP Esters (Oligonucleotide 111); Preparation of ISIS 666881 (GalNAc$_3$-10)

A 5'-hexylamino modified oligonucleotide was synthesized and purified using standard solid-phase oligonucleotide procedures. The 5'-hexylamino modified oligonucleotide was dissolved in 0.1 M sodium tetraborate, pH 8.5 (200 µL) and 3 equivalents of a selected PFP esterified GalNAc$_3$ cluster dissolved in DMSO (50 µL) was added. If the PFP ester precipitated upon addition to the ASO solution DMSO was added until all PFP ester was in solution. The reaction was complete after about 16 h of mixing at room temperature. The resulting solution was diluted with water to 12 mL and then spun down at 3000 rpm in a spin filter with a mass cut off of 3000 Da. This process was repeated twice to remove small molecule impurities. The solution was then lyophilized to dryness and redissolved in concentrated aqueous ammonia and mixed at room temperature for 2.5 h followed by concentration in vacuo to remove most of the ammonia. The conjugated oligonucleotide was purified and desalted by RP-HPLC and lyophilized to provide the GalNAc$_3$ conjugated oligonucleotide.

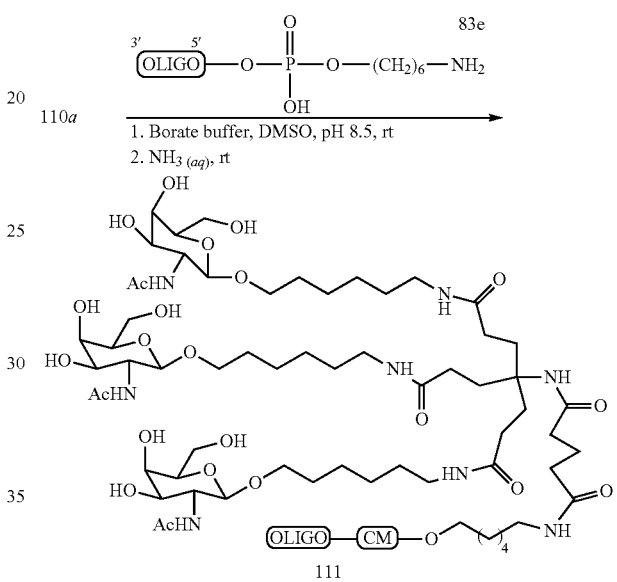

Oligonucleotide 111 is conjugated with GalNAc$_3$-10. The GalNAc$_3$ cluster portion of the conjugate group GalNAc$_3$-10 (GalNAc$_3$-10$_a$) can be combined with any cleavable moiety to provide a variety of conjugate groups. In certain embodiments, the cleavable moiety is —P(=O)(OH)-A$_d$-P(=O)(OH)— as shown in the oligonucleotide (ISIS 666881) synthesized with GalNAc$_3$-10 below. The structure of GalNAc$_3$-10 (GalNAc$_3$-10$_a$-CM-) is shown below:

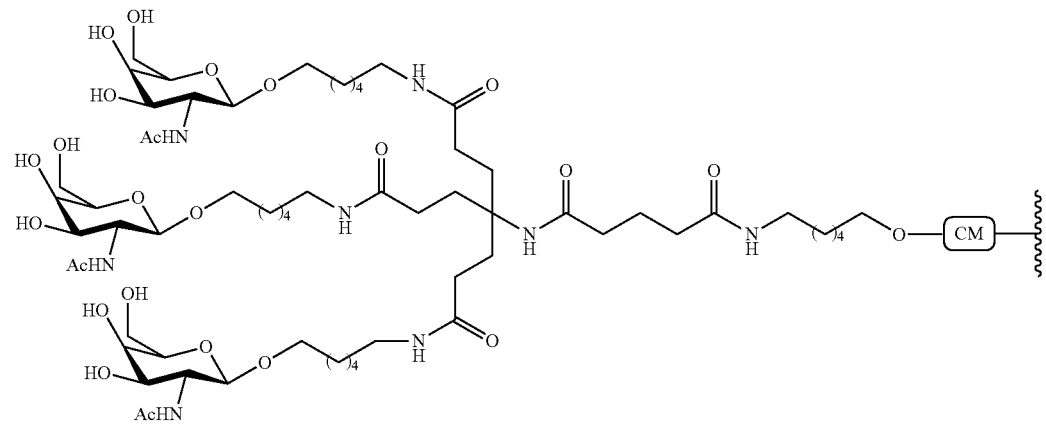

Following this general procedure ISIS 666881 was prepared. 5'-hexylamino modified oligonucleotide, ISIS 660254, was synthesized and purified using standard solid-phase oligonucleotide procedures. ISIS 660254 (40 mg, 5.2 μmol) was dissolved in 0.1 M sodium tetraborate, pH 8.5 (200 μL) and 3 equivalents PFP ester (Compound 110a) dissolved in DMSO (50 μL) was added. The PFP ester precipitated upon addition to the ASO solution requiring additional DMSO (600 μL) to fully dissolve the PFP ester. The reaction was complete after 16 h of mixing at room temperature. The solution was diluted with water to 12 mL total volume and spun down at 3000 rpm in a spin filter with a mass cut off of 3000 Da. This process was repeated twice to remove small molecule impurities. The solution was lyophilized to dryness and redissolved in concentrated aqueous ammonia with mixing at room temperature for 2.5 h followed by concentration in vacuo to remove most of the ammonia. The conjugated oligonucleotide was purified and desalted by RP-HPLC and lyophilized to give ISIS 666881 in 90% yield by weight (42 mg, 4.7 μmol).

| ASO | Sequence (5' to 3') | 5' group | SEQ ID No. |
|---|---|---|---|
| | GalNAc$_3$-10 conjugated oligonucleotide | | |
| ISIS 660254 | NH$_2$(CH$_2$)$_6$-$_o$'A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | Hexylamine | 4888 |
| ISIS 666881 | GalNAc$_3$-10$_{a}$-$_{o'}$A$_{do}$G$_{es}$$^m$C$_{es}$T$_{es}$T$_{es}$$^m$C$_{es}$A$_{ds}$G$_{ds}$T$_{ds}$ $^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-10 | 4888 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

Example 47

Preparation of Oligonucleotide 102 Comprising GalNAc$_3$-8

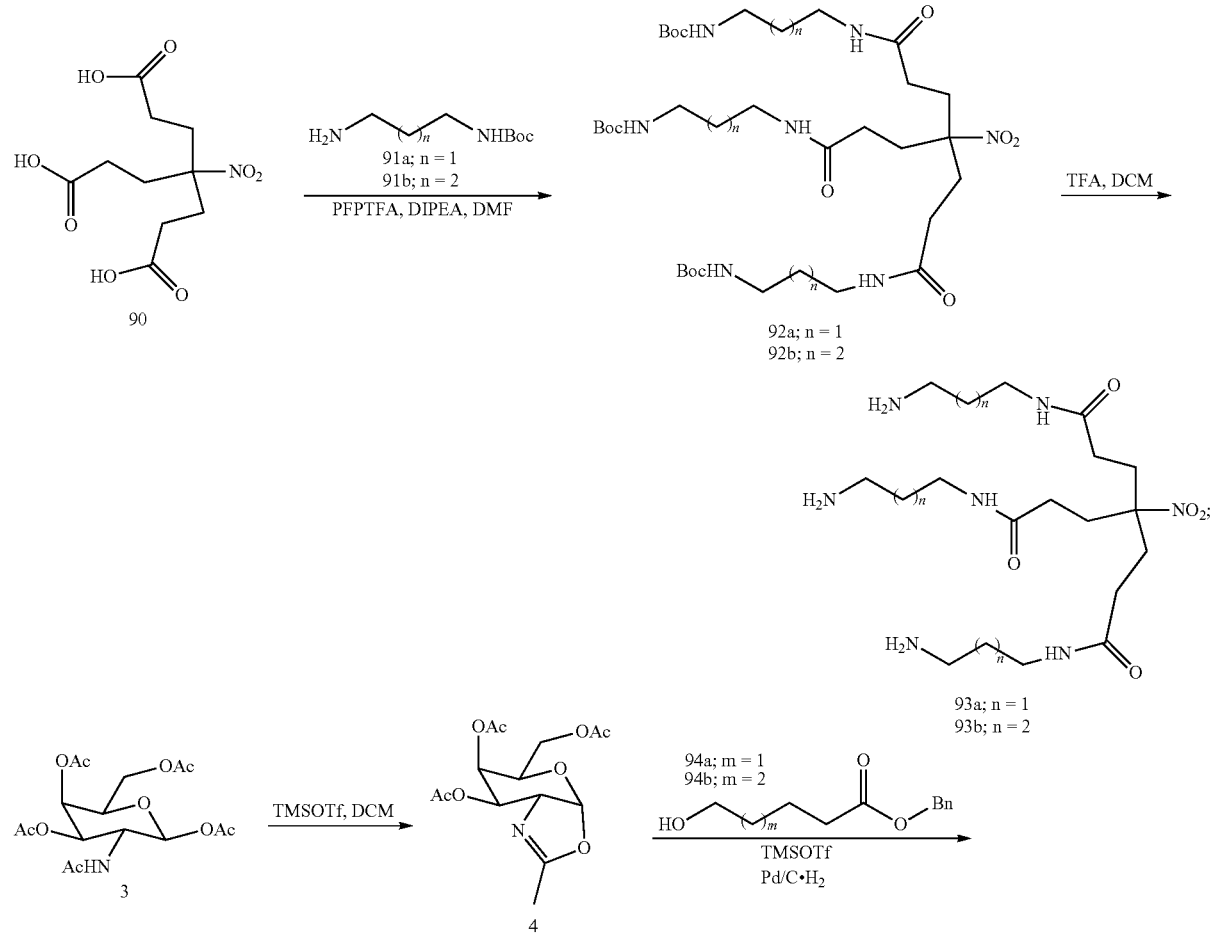

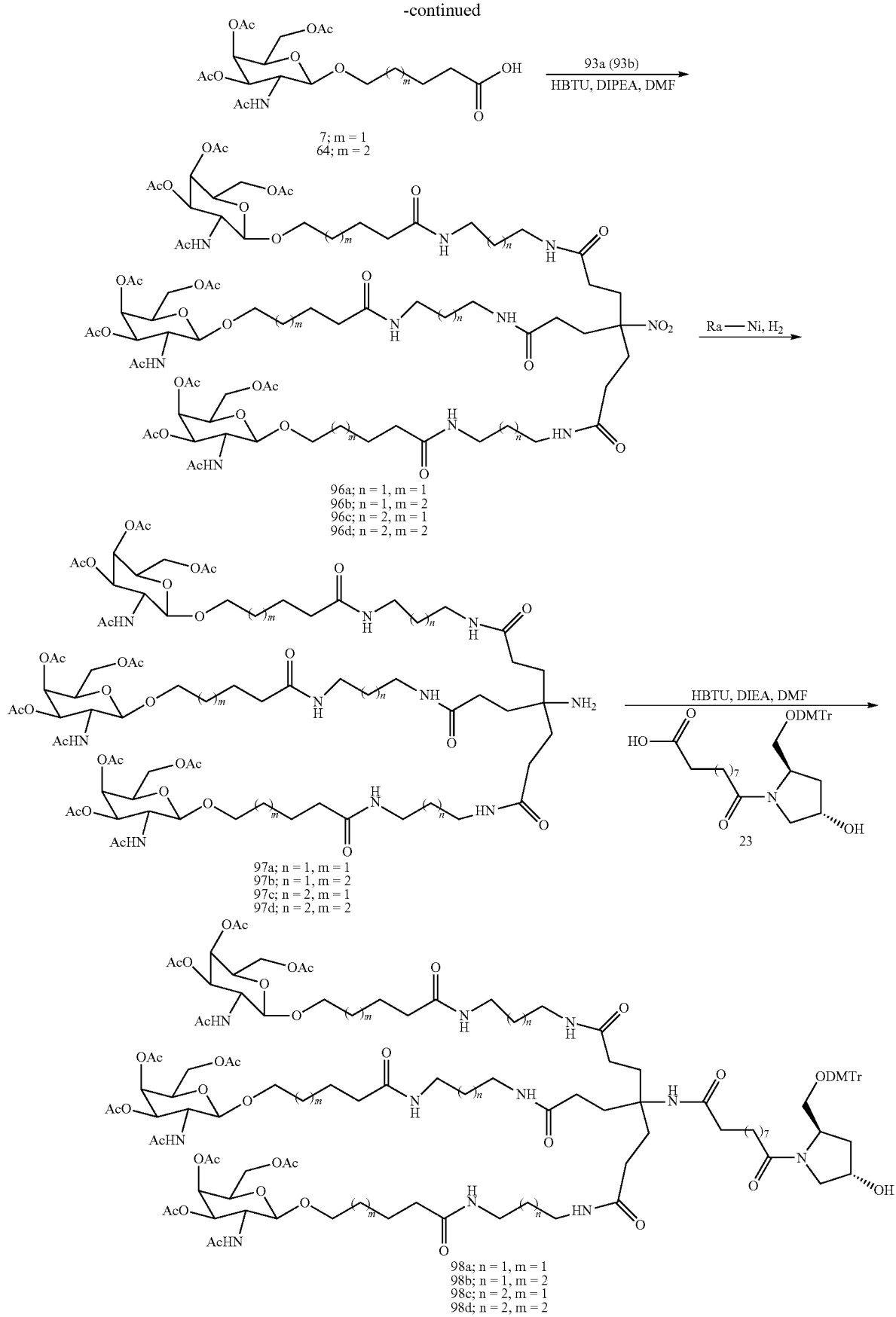

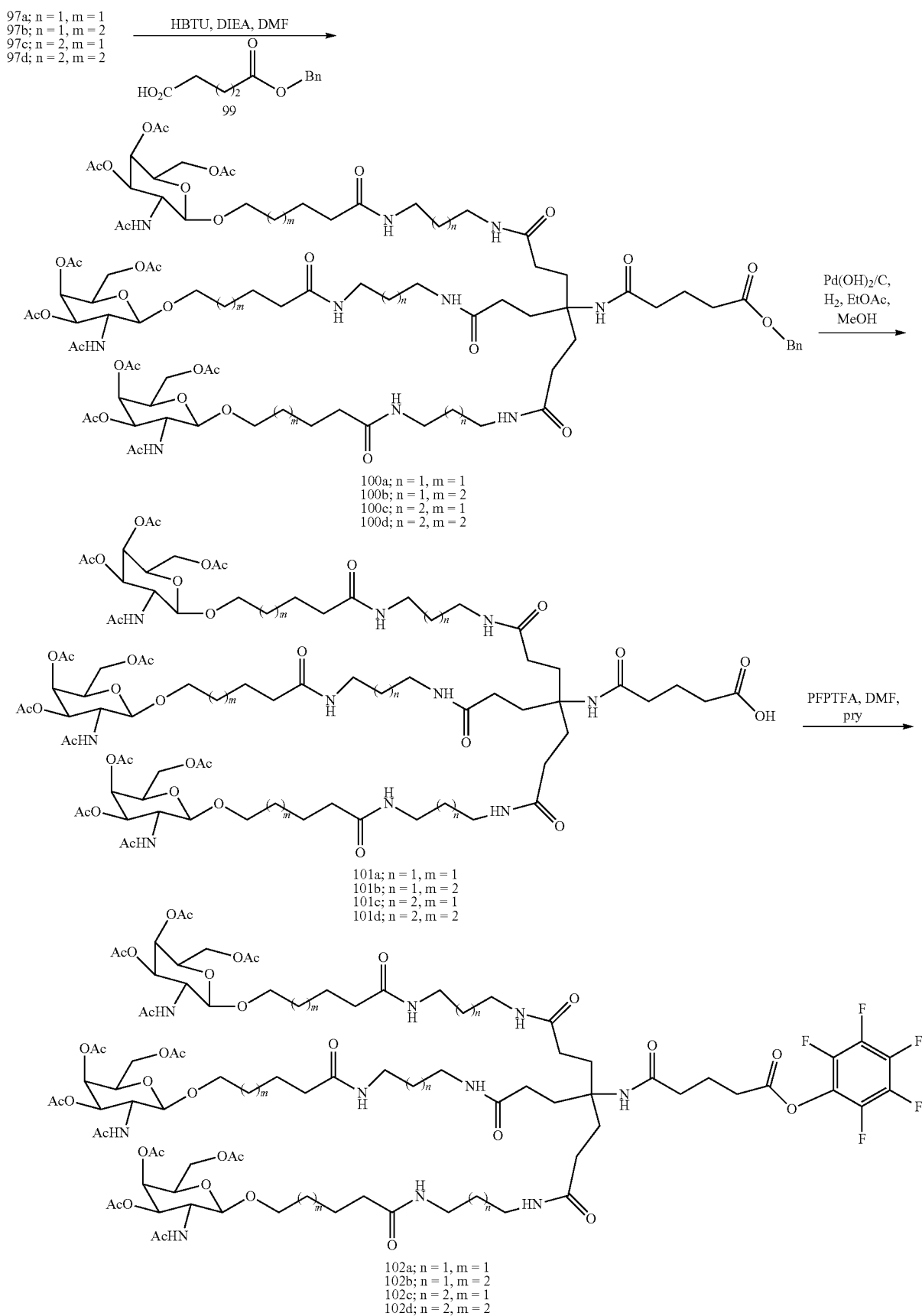

The triacid 90 (4 g, 14.43 mmol) was dissolved in DMF (120 mL) and N,N-Diisopropylethylamine (12.35 mL, 72 mmoles). Pentafluorophenyl trifluoroacetate (8.9 mL, 52 mmoles) was added dropwise, under argon, and the reaction was allowed to stir at room temperature for 30 minutes. Boc-diamine 91a or 91b (68.87 mmol) was added, along with N,N-Diisopropylethylamine (12.35 mL, 72 mmoles), and the reaction was allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%→10% methanol/dichloromethane) to give compounds 92a and 92b in an approximate 80% yield. LCMS and proton NMR were consistent with the structure.

Compound 92a or 92b (6.7 mmoles) was treated with 20 mL of dichloromethane and 20 mL of trifluoroacetic acid at room temperature for 16 hours. The resultant solution was evaporated and then dissolved in methanol and treated with DOWEX-OH resin for 30 minutes. The resultant solution was filtered and reduced to an oil under reduced pressure to give 85-90% yield of compounds 93a and 93b.

Compounds 7 or 64 (9.6 mmoles) were treated with HBTU (3.7 g, 9.6 mmoles) and N,N-Diisopropylethylamine (5 mL) in DMF (20 mL) for 15 minutes. To this was added either compounds 93a or 93b (3 mmoles), and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%→20% methanol/dichloromethane) to give compounds 96a-d in 20-40% yield. LCMS and proton NMR was consistent with the structure.

Compounds 96a-d (0.75 mmoles), individually, were hydrogenated over Raney Nickel for 3 hours in Ethanol (75 mL). At that time, the catalyst was removed by filtration thru celite, and the ethanol removed under reduced pressure to give compounds 97a-d in 80-90% yield. LCMS and proton NMR were consistent with the structure.

Compound 23 (0.32 g, 0.53 mmoles) was treated with HBTU (0.2 g, 0.53 mmoles) and N,N-Diisopropylethylamine (0.19 mL, 1.14 mmoles) in DMF (30 mL) for 15 minutes. To this was added compounds 97a-d (0.38 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%→20% methanol/dichloromethane) to give compounds 98a-d in 30-40% yield. LCMS and proton NMR was consistent with the structure.

Compound 99 (0.17 g, 0.76 mmoles) was treated with HBTU (0.29 g, 0.76 mmoles) and N,N-Diisopropylethylamine (0.35 mL, 2.0 mmoles) in DMF (50 mL) for 15 minutes. To this was added compounds 97a-d (0.51 mmoles), individually, and allowed to stir at room temperature for 16 hours. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (5%→20% methanol/dichloromethane) to give compounds 100a-d in 40-60% yield. LCMS and proton NMR was consistent with the structure.

Compounds 100a-d (0.16 mmoles), individually, were hydrogenated over 10% Pd(OH)$_2$/C for 3 hours in methanol/ethyl acetate (1:1, 50 mL). At that time, the catalyst was removed by filtration thru celite, and the organics removed under reduced pressure to give compounds 101a-d in 80-90% yield. LCMS and proton NMR was consistent with the structure.

Compounds 101a-d (0.15 mmoles), individually, were dissolved in DMF (15 mL) and pyridine (0.016 mL, 0.2 mmoles). Pentafluorophenyl trifluoroacetate (0.034 mL, 0.2 mmoles) was added dropwise, under argon, and the reaction was allowed to stir at room temperature for 30 minutes. At that time, the DMF was reduced by >75% under reduced pressure, and then the mixture was dissolved in dichloromethane. The organic layer was washed with sodium bicarbonate, water and brine. The organic layer was then separated and dried over sodium sulfate, filtered and reduced to an oil under reduced pressure. The resultant oil was purified by silica gel chromatography (2%→5% methanol/dichloromethane) to give compounds 102a-d in an approximate 80% yield. LCMS and proton NMR were consistent with the structure.

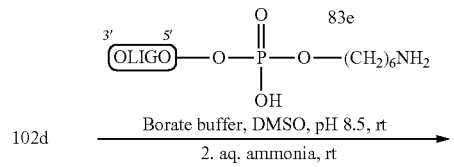

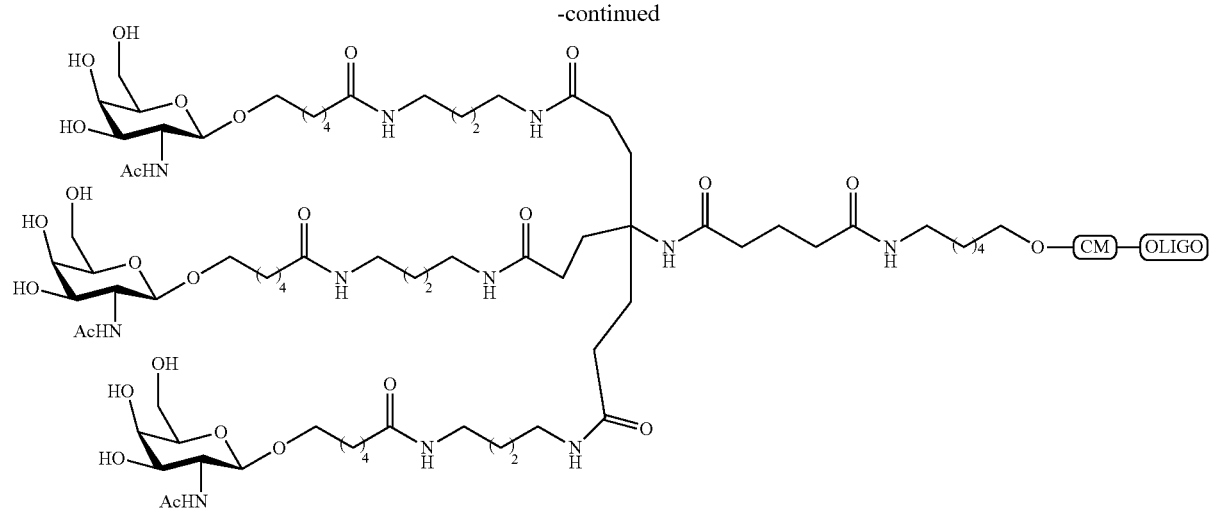

102

Oligomeric Compound 102, comprising a GalNAc₃-8 conjugate group, was prepared using the general procedures illustrated in Example 46. The GalNAc₃ cluster portion of the conjugate group GalNAc₃-8 (GalNAc₃-8$_a$) can be combined with any cleavable moiety to provide a variety of conjugate groups. In a preferred embodiment, the cleavable moiety is —P(=O)(OH)-A$_d$-P(=O)(OH)—.

The structure of GalNAc₃-8 (GalNAc₃-8$_a$-CM-) is shown below:

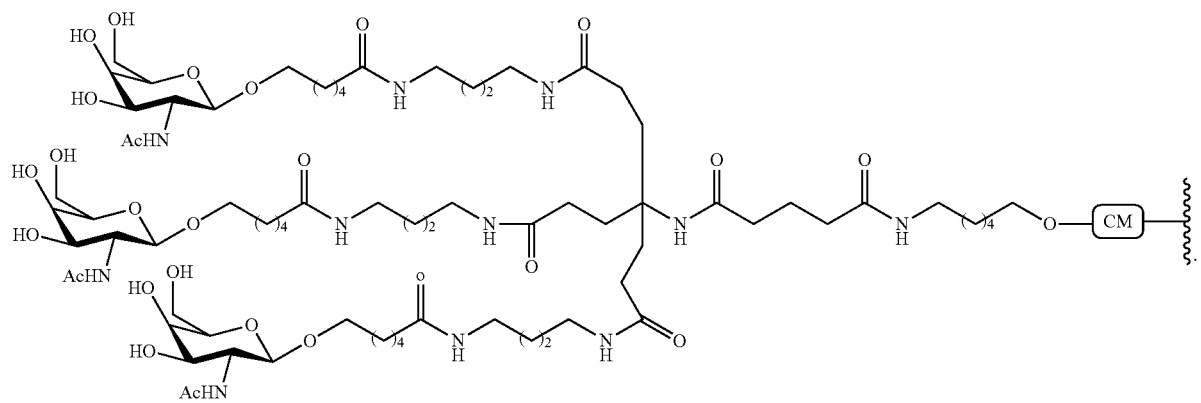

50

Example 48

Preparation of Oligonucleotide 119 Comprising GalNAc₃-7

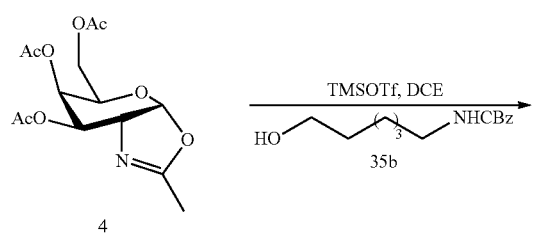

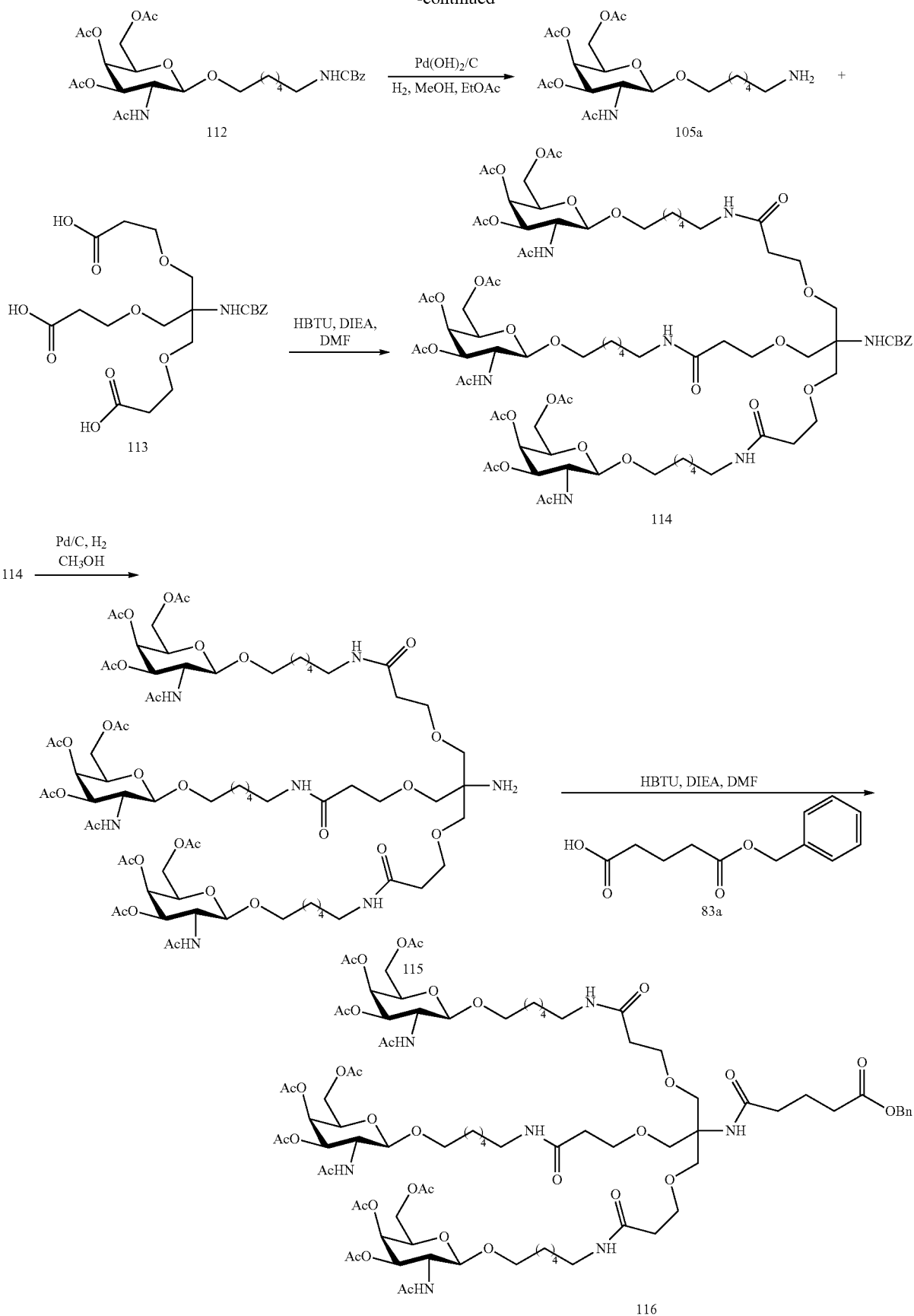

Compound 112 was synthesized following the procedure described in the literature (*J. Med. Chem.* 2004, 47, 5798-5808).

Compound 112 (5 g, 8.6 mmol) was dissolved in 1:1 methanol/ethyl acetate (22 mL/22 mL). Palladium hydroxide on carbon (0.5 g) was added. The reaction mixture was stirred at room temperature under hydrogen for 12 h. The reaction mixture was filtered through a pad of celite and washed the pad with 1:1 methanol/ethyl acetate. The filtrate and the washings were combined and concentrated to dryness to yield Compound 105a (quantitative). The structure was confirmed by LCMS.

Compound 113 (1.25 g, 2.7 mmol), HBTU (3.2 g, 8.4 mmol) and DIEA (2.8 mL, 16.2 mmol) were dissolved in anhydrous DMF (17 mL) and the reaction mixture was stirred at room temperature for 5 min To this a solution of Compound 105a (3.77 g, 8.4 mmol) in anhydrous DMF (20 mL) was added. The reaction was stirred at room temperature for 6 h. Solvent was removed under reduced pressure to get an oil. The residue was dissolved in CH$_2$Cl$_2$ (100 mL) and washed with aqueous saturated NaHCO$_3$ solution (100 mL) and brine (100 mL). The organic phase was separated, dried (Na$_2$SO$_4$), filtered and evaporated. The residue was purified by silica gel column chromatography and eluted with 10 to 20% MeOH in dichloromethane to yield Compound 114 (1.45 g, 30%). The structure was confirmed by LCMS and $^1$H NMR analysis.

Compound 114 (1.43 g, 0.8 mmol) was dissolved in 1:1 methanol/ethyl acetate (4 mL/4 mL). Palladium on carbon (wet, 0.14 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield Compound 115 (quantitative). The structure was confirmed by LCMS and $^1$H NMR analysis.

Compound 83a (0.17 g, 0.75 mmol), HBTU (0.31 g, 0.83 mmol) and DIEA (0.26 mL, 1.5 mmol) were dissolved in anhydrous DMF (5 mL) and the reaction mixture was stirred at room temperature for 5 min. To this a solution of Compound 115 (1.22 g, 0.75 mmol) in anhydrous DMF was added and the reaction was stirred at room temperature for 6 h. The solvent was removed under reduced pressure and the residue was dissolved in CH$_2$Cl$_2$. The organic layer was washed aqueous saturated NaHCO$_3$ solution and brine and dried over anhydrous Na$_2$SO$_4$ and filtered. The organic layer was concentrated to dryness and the residue obtained was purified by silica gel column chromatography and eluted with 3 to 15% MeOH in dichloromethane to yield Compound 116 (0.84 g, 61%). The structure was confirmed by LC MS and $^1$H NMR analysis.

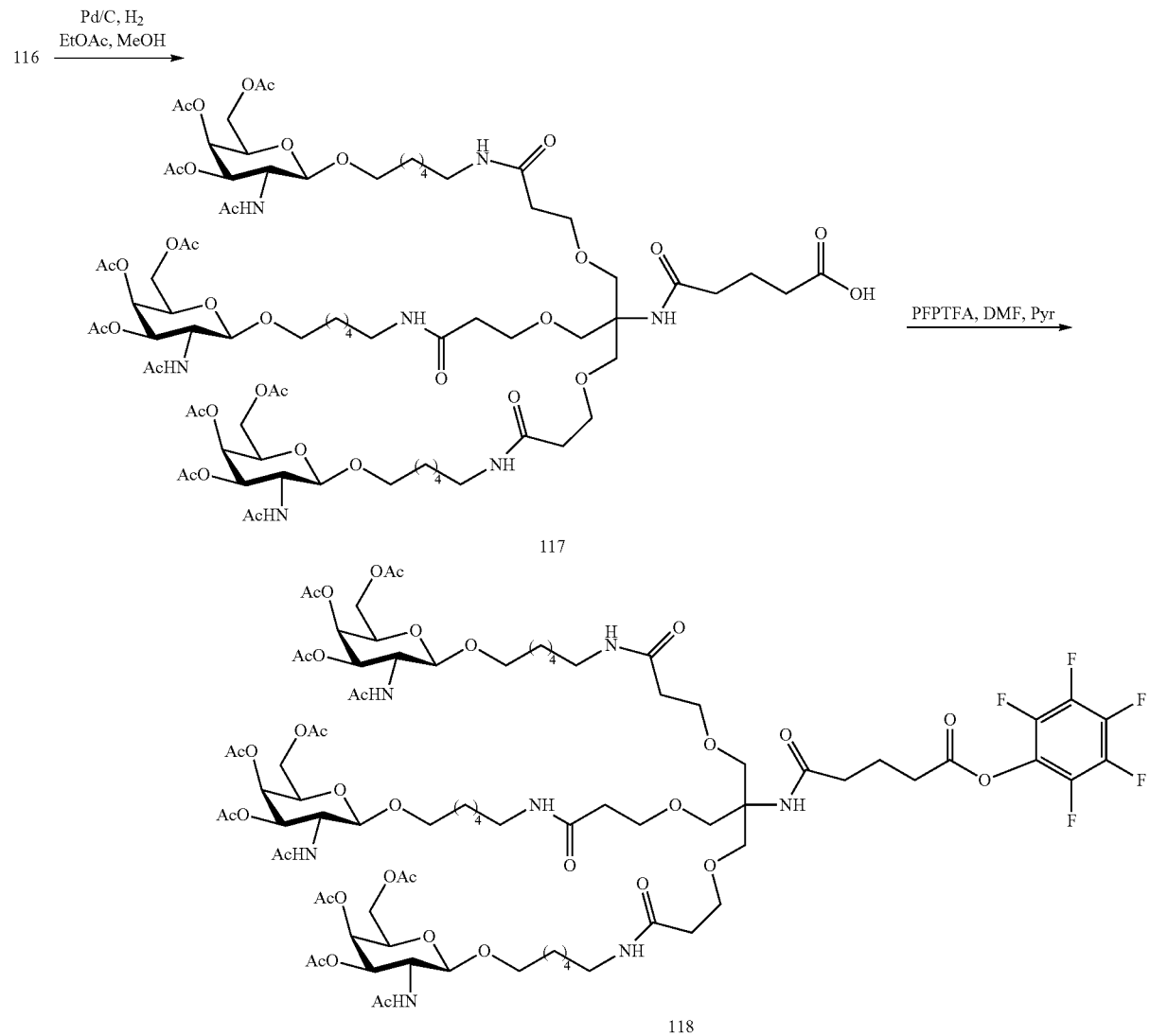

Compound 116 (0.74 g, 0.4 mmol) was dissolved in 1:1 methanol/ethyl acetate (5 mL/5 mL). Palladium on carbon (wet, 0.074 g) was added. The reaction mixture was flushed with hydrogen and stirred at room temperature under hydrogen for 12 h. The reaction mixture was filtered through a pad of celite. The celite pad was washed with methanol/ethyl acetate (1:1). The filtrate and the washings were combined together and evaporated under reduced pressure to yield compound 117 (0.73 g, 98%). The structure was confirmed by LCMS and $^1$H NMR analysis.

Compound 117 (0.63 g, 0.36 mmol) was dissolved in anhydrous DMF (3 mL). To this solution N,N-Diisopropylethylamine (70 µL, 0.4 mmol) and pentafluorophenyl trifluoroacetate (72 µL, 0.42 mmol) were added. The reaction mixture was stirred at room temperature for 12 h and poured into a aqueous saturated NaHCO$_3$ solution. The mixture was extracted with dichloromethane, washed with brine and dried over anhydrous Na$_2$SO$_4$. The dichloromethane solution was concentrated to dryness and purified with silica gel column chromatography and eluted with 5 to 10% MeOH in dichloromethane to yield compound 118 (0.51 g, 79%). The structure was confirmed by LCMS and $^1$H and $^1$H and $^{19}$F NMR.

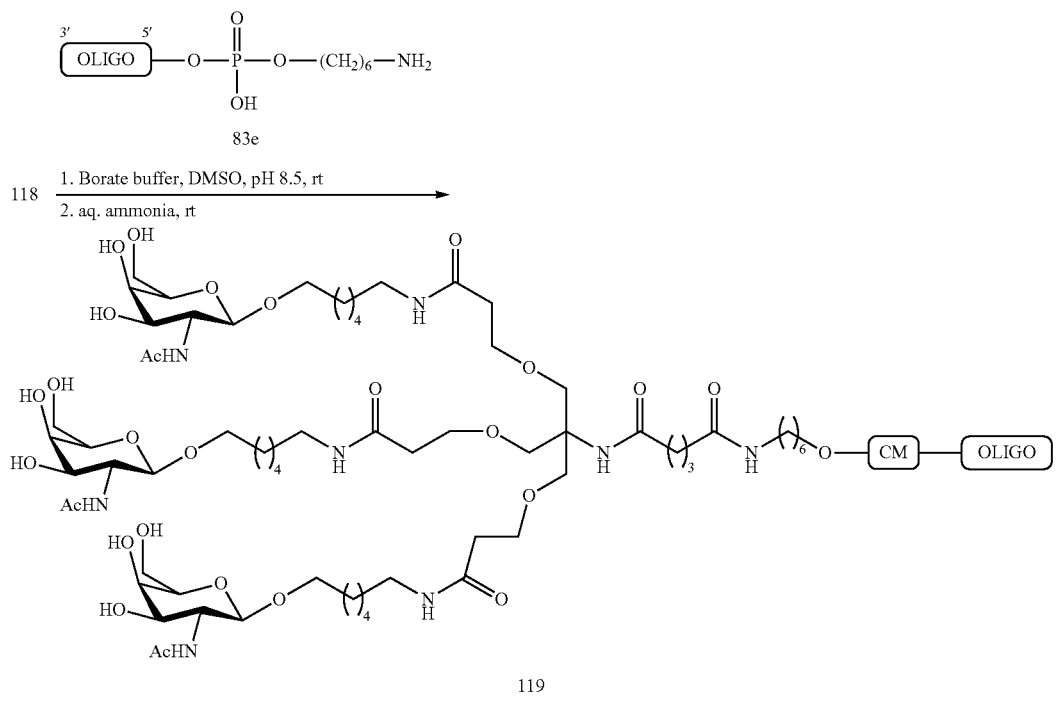

Oligomeric Compound 119, comprising a GalNAc$_3$-7 conjugate group, was prepared using the general procedures illustrated in Example 46. The GalNAc$_3$ cluster portion of the conjugate group GalNAc$_3$-7 (GalNAc$_3$-7$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-7 (GalNAc$_3$-7$_a$-CM-) is shown below:

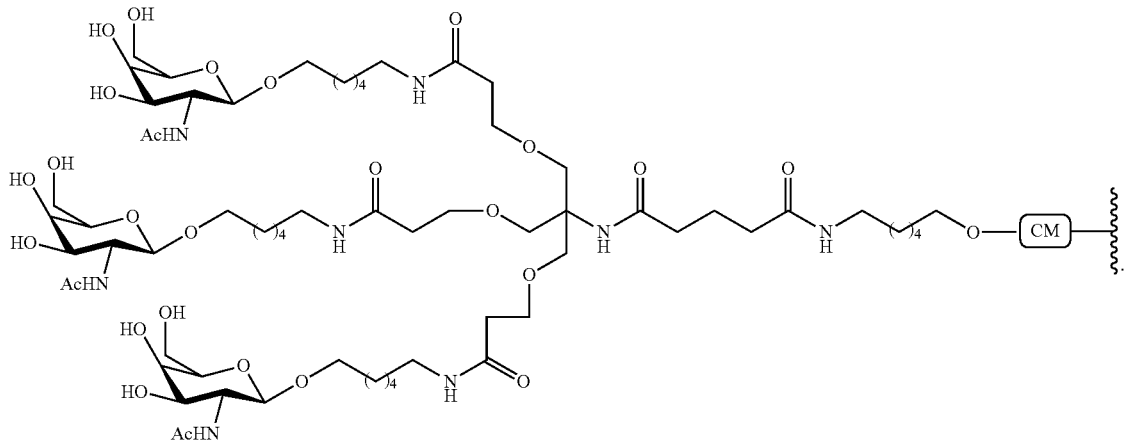

Example 49

Preparation of Oligonucleotide 132 Comprising GalNAc₃-5

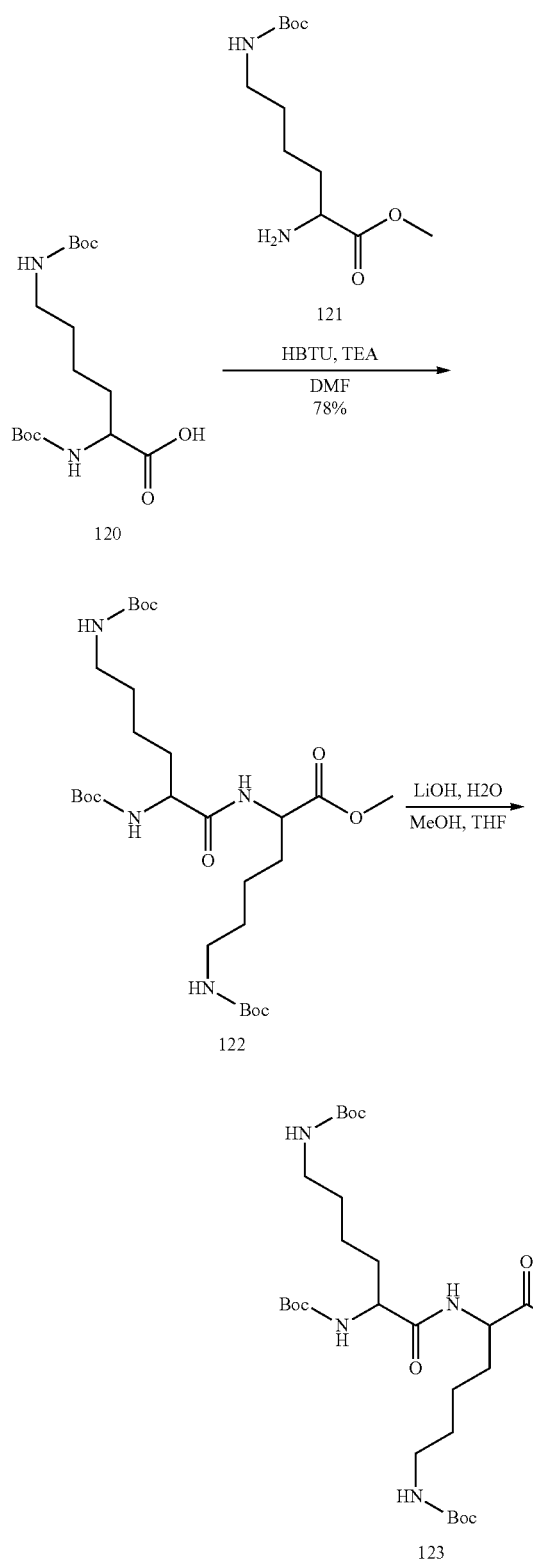

Compound 120 (14.01 g, 40 mmol) and HBTU (14.06 g, 37 mmol) were dissolved in anhydrous DMF (80 mL). Triethylamine (11.2 mL, 80.35 mmol) was added and stirred for 5 min. The reaction mixture was cooled in an ice bath and a solution of compound 121 (10 g, mmol) in anhydrous DMF (20 mL) was added. Additional triethylamine (4.5 mL, 32.28 mmol) was added and the reaction mixture was stirred for 18 h under an argon atmosphere. The reaction was monitored by TLC (ethyl acetate:hexane; 1:1; Rf=0.47). The solvent was removed under reduced pressure. The residue was taken up in EtOAc (300 mL) and washed with 1M NaHSO₄ (3×150 mL), aqueous saturated NaHCO₃ solution (3×150 mL) and brine (2×100 mL). Organic layer was dried with Na₂SO₄. Drying agent was removed by filtration and organic layer was concentrated by rotary evaporation. Crude mixture was purified by silica gel column chromatography and eluted by using 35-50% EtOAc in hexane to yield a compound 122 (15.50 g, 78.13%). The structure was confirmed by LCMS and ¹H NMR analysis. Mass m/z 589.3 [M+H]⁺.

A solution of LiOH (92.15 mmol) in water (20 mL) and THF (10 mL) was added to a cooled solution of Compound 122 (7.75 g, 13.16 mmol) dissolved in methanol (15 mL). The reaction mixture was stirred at room temperature for 45 min and monitored by TLC (EtOAc:hexane; 1:1). The reaction mixture was concentrated to half the volume under reduced pressure. The remaining solution was cooled an ice bath and neutralized by adding concentrated HCl. The reaction mixture was diluted, extracted with EtOAc (120 mL) and washed with brine (100 mL). An emulsion formed and cleared upon standing overnight. The organic layer was separated dried (Na₂SO₄), filtered and evaporated to yield Compound 123 (8.42 g). Residual salt is the likely cause of excess mass. LCMS is consistent with structure. Product was used without any further purification. M.W.cal:574.36; M.W.fd:575.3 [M+H]⁺.

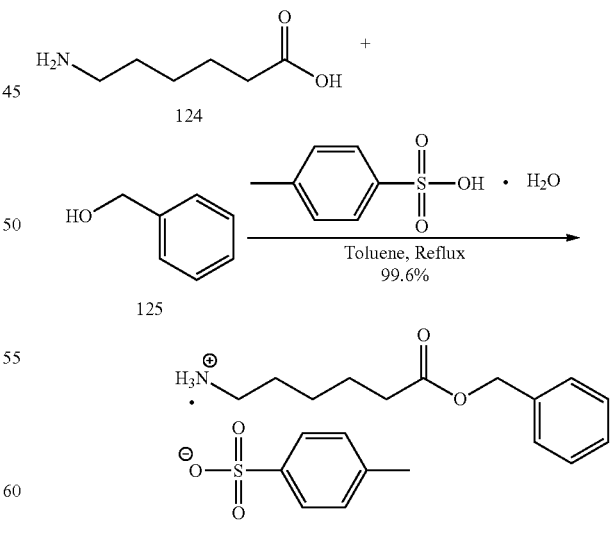

Compound 126 was synthesized following the procedure described in the literature (*J. Am. Chem. Soc.* 2011, 133, 958-963).

335                                                                                          336
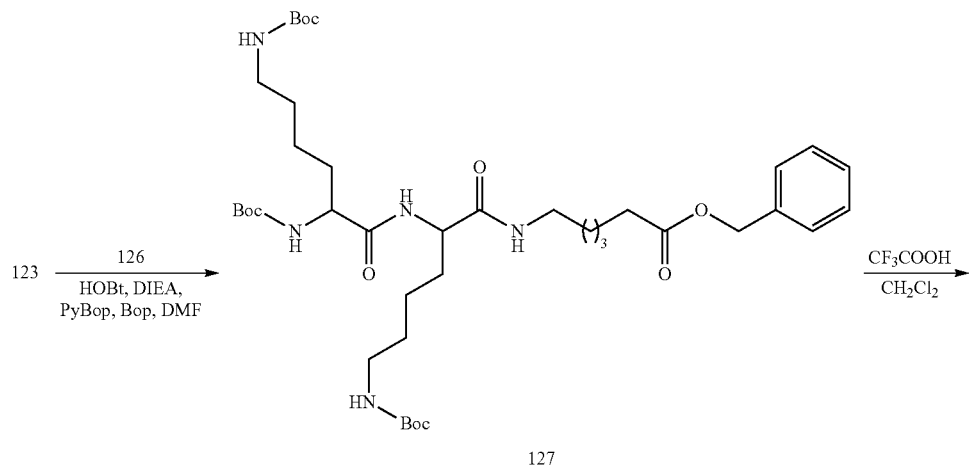
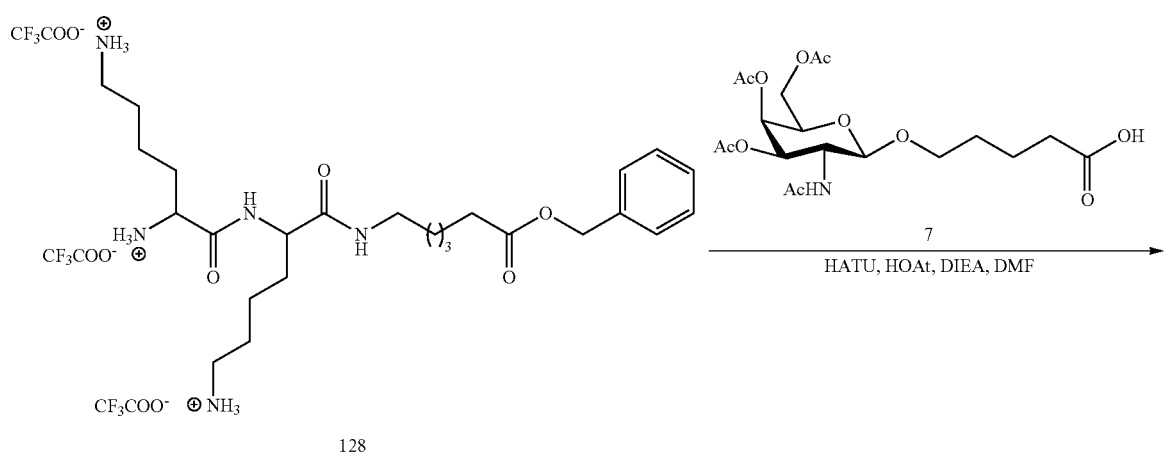
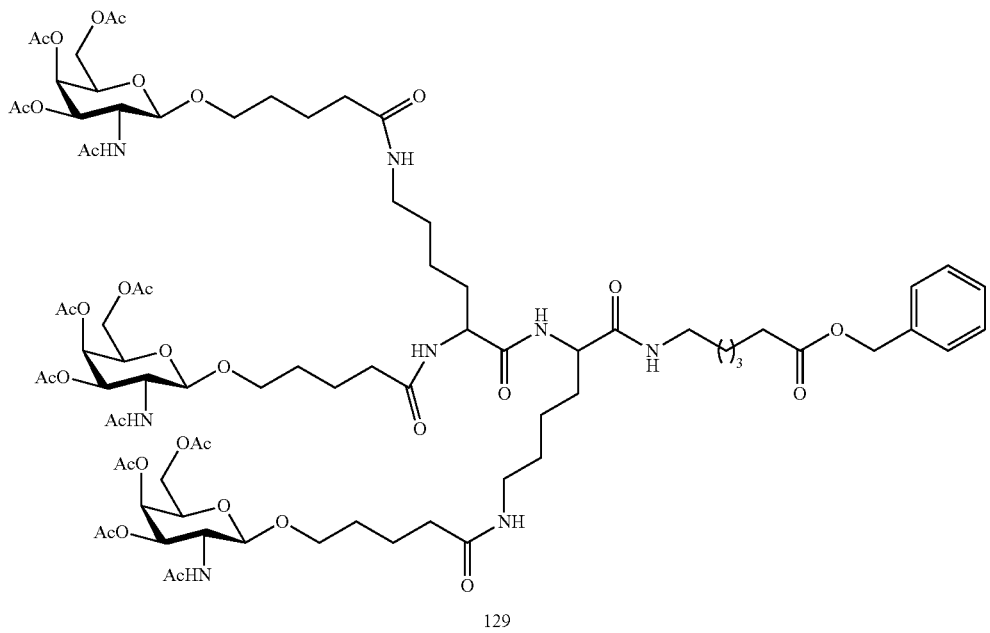

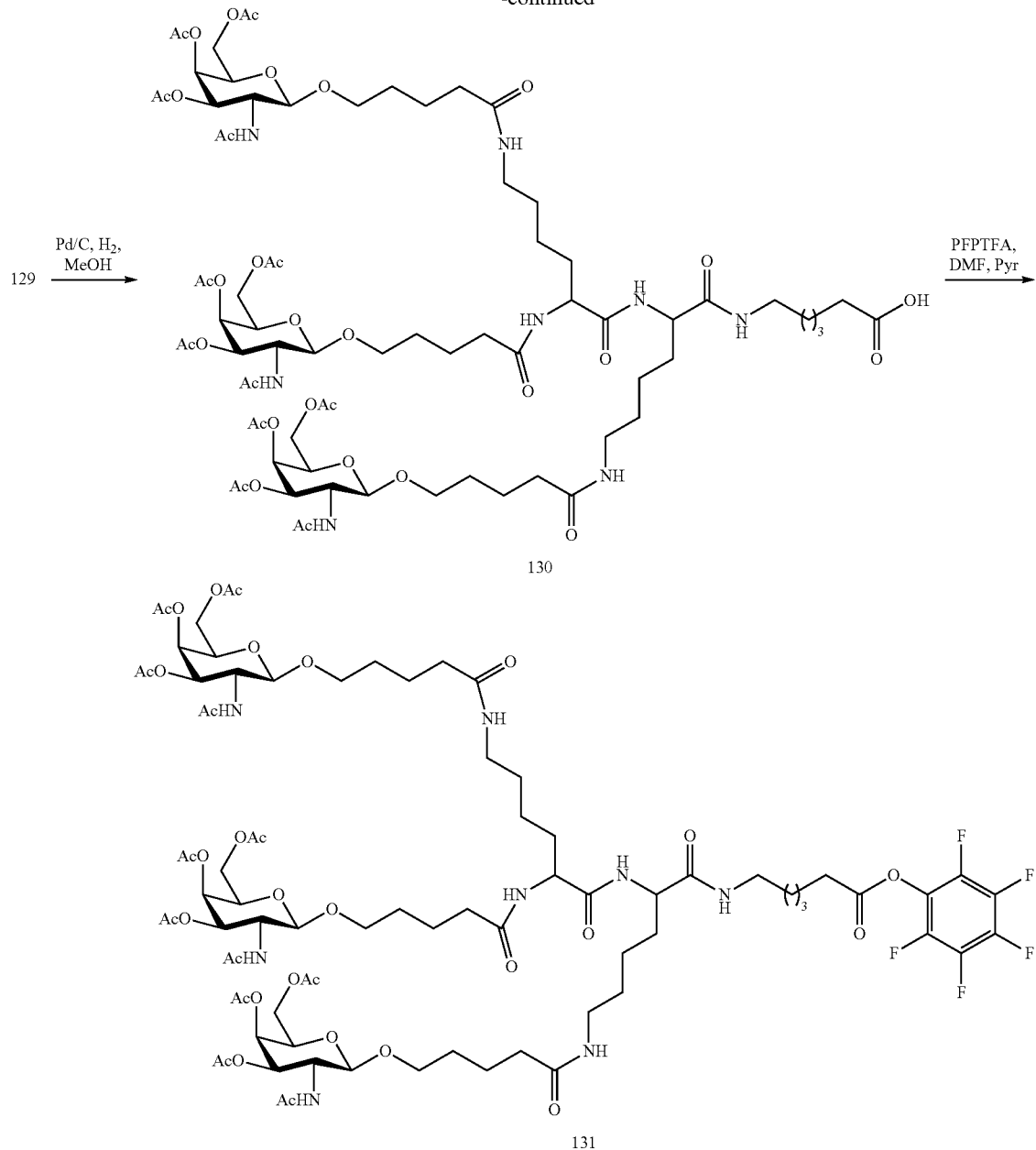

Compound 123 (7.419 g, 12.91 mmol), HOBt (3.49 g, 25.82 mmol) and compound 126 (6.33 g, 16.14 mmol) were dissolved in and DMF (40 mL) and the resulting reaction mixture was cooled in an ice bath. To this N,N-Diisopropylethylamine (4.42 mL, 25.82 mmol), PyBop (8.7 g, 16.7 mmol) followed by Bop coupling reagent (1.17 g, 2.66 mmol) were added under an argon atmosphere. The ice bath was removed and the solution was allowed to warm to room temperature. The reaction was completed after 1 h as determined by TLC (DCM:MeOH:AA; 89:10:1). The reaction mixture was concentrated under reduced pressure. The residue was dissolved in EtOAc (200 mL) and washed with 1 M NaHSO$_4$ (3×100 mL), aqueous saturated NaHCO$_3$ (3×100 mL) and brine (2×100 mL). The organic phase separated dried (Na$_2$SO$_4$), filtered and concentrated. The residue was purified by silica gel column chromatography with a gradient of 50% hexanes/EtOAC to 100% EtOAc to yield Compound 127 (9.4 g) as a white foam. LCMS and $^1$H NMR were consistent with structure. Mass m/z 778.4 [M+H]$^+$.

Trifluoroacetic acid (12 mL) was added to a solution of compound 127 (1.57 g, 2.02 mmol) in dichloromethane (12 mL) and stirred at room temperature for 1 h. The reaction mixture was co-evaporated with toluene (30 mL) under reduced pressure to dryness. The residue obtained was co-evaporated twice with acetonitrile (30 mL) and toluene (40 mL) to yield Compound 128 (1.67 g) as trifluoro acetate salt and used for next step without further purification. LCMS and $^1$H NMR were consistent with structure. Mass m/z 478.2 [M+H]$^+$.

Compound 7 (0.43 g, 0.963 mmol), HATU (0.35 g, 0.91 mmol), and HOAt (0.035 g, 0.26 mmol) were combined together and dried for 4 h over P$_2$O$_5$ under reduced pressure in a round bottom flask and then dissolved in anhydrous DMF (1 mL) and stirred for 5 min To this a solution of compound 128 (0.20 g, 0.26 mmol) in anhydrous DMF (0.2 mL) and N,N-Diisopropylethylamine (0.2 mL) was added. The reaction mixture was stirred at room temperature under an argon atmosphere. The reaction was complete after 30 min as determined by LCMS and TLC (7% MeOH/DCM). The reaction mixture was concentrated under reduced pressure. The residue was dissolved in DCM (30 mL) and washed with 1 M $NaHSO_4$ (3×20 mL), aqueous saturated $NaHCO_3$ (3×20 mL) and brine (3×20 mL). The organic phase was separated, dried over $Na_2SO_4$, filtered and concentrated. The residue was purified by silica gel column chromatography using 5-15% MeOH in dichloromethane to yield Compound 129 (96.6 mg). LC MS and $^1$H NMR are consistent with structure. Mass m/z 883.4 $[M+2H]^+$.

Compound 129 (0.09 g, 0.051 mmol) was dissolved in methanol (5 mL) in 20 mL scintillation vial. To this was added a small amount of 10% Pd/C (0.015 mg) and the reaction vessel was flushed with $H_2$ gas. The reaction mixture was stirred at room temperature under $H_2$ atmosphere for 18 h. The reaction mixture was filtered through a pad of Celite and the Celite pad was washed with methanol. The filtrate washings were pooled together and concentrated under reduced pressure to yield Compound 130 (0.08 g). LCMS and $^1$H NMR were consistent with structure. The product was used without further purification. Mass m/z 838.3 $[M+2H]^+$.

To a 10 mL pointed round bottom flask were added compound 130 (75.8 mg, 0.046 mmol), 0.37 M pyridine/DMF (200 μL) and a stir bar. To this solution was added 0.7 M pentafluorophenyl trifluoroacetate/DMF (100 μL) drop wise with stirring. The reaction was completed after 1 h as determined by LC MS. The solvent was removed under reduced pressure and the residue was dissolved in $CHCl_3$ (~10 mL). The organic layer was partitioned against $NaHSO_4$ (1 M, 10 mL), aqueous saturated $NaHCO_3$ (10 mL) and brine (10 mL) three times each. The organic phase separated and dried over $Na_2SO_4$, filtered and concentrated to yield Compound 131 (77.7 mg). LCMS is consistent with structure. Used without further purification. Mass m/z 921.3 $[M+2H]^+$.

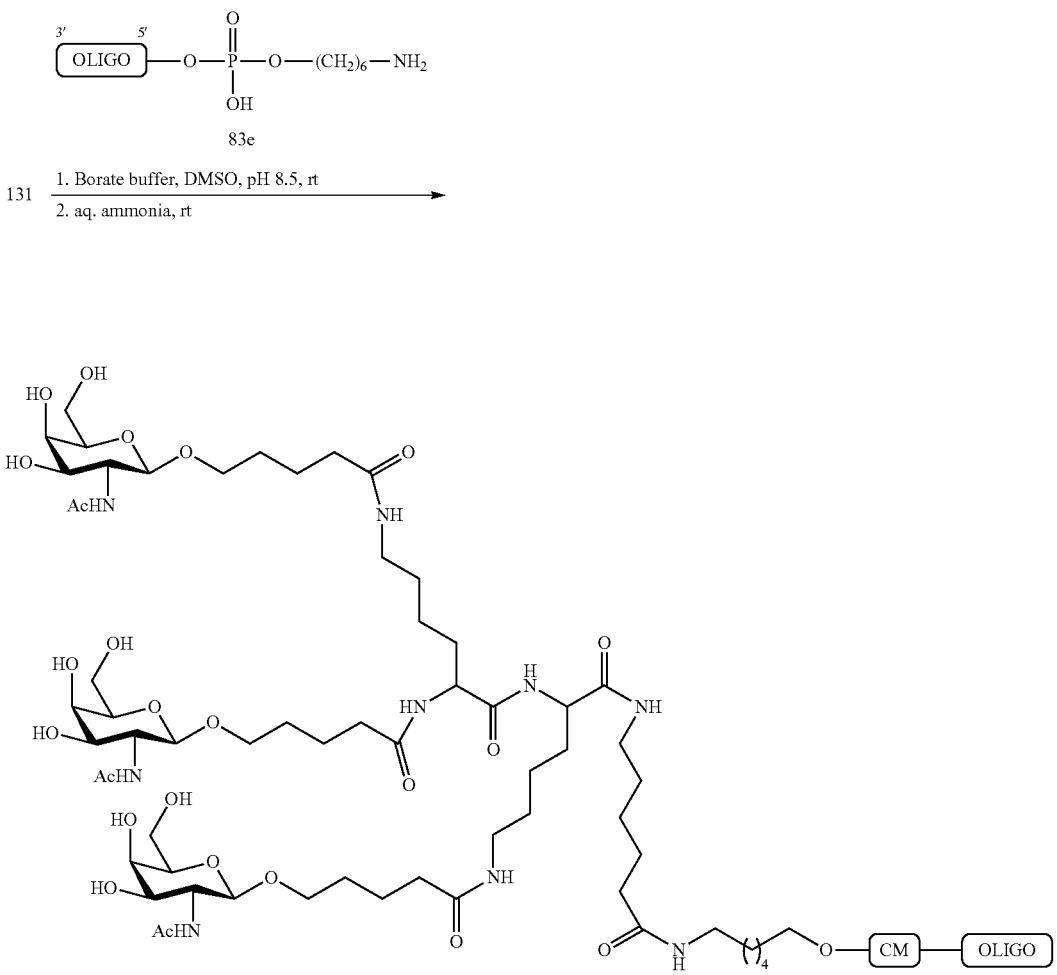

Oligomeric Compound 132, comprising a GalNAc$_3$-5 conjugate group, was prepared using the general procedures illustrated in Example 46. The GalNAc$_3$ cluster portion of the conjugate group GalNAc$_3$-5 (GalNAc$_3$-5$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-5 (GalNAc$_3$-5$_a$-CM-) is shown below:

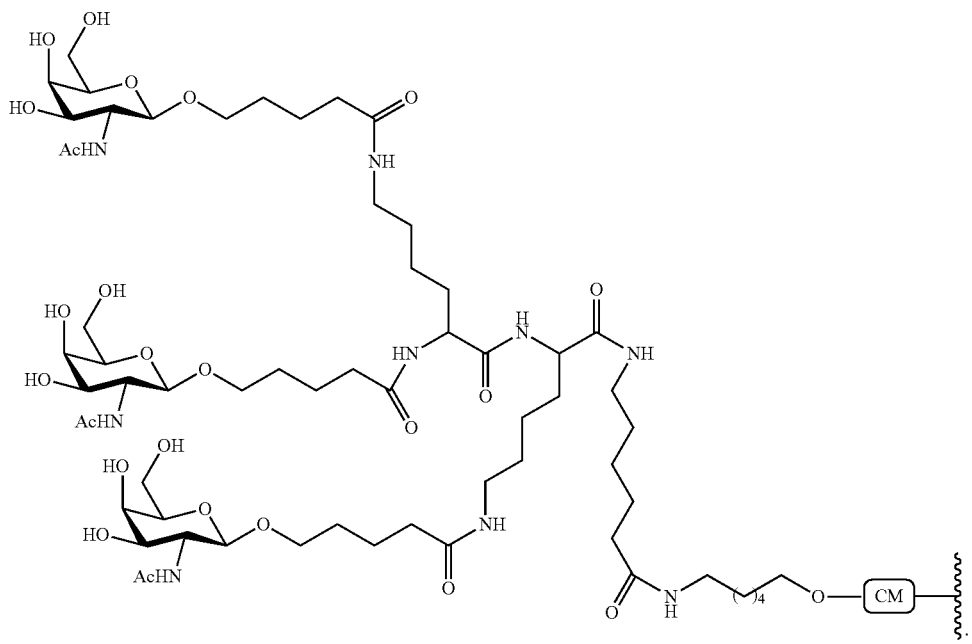

Example 50

Preparation of Oligonucleotide 144 Comprising GalNAc$_4$-11

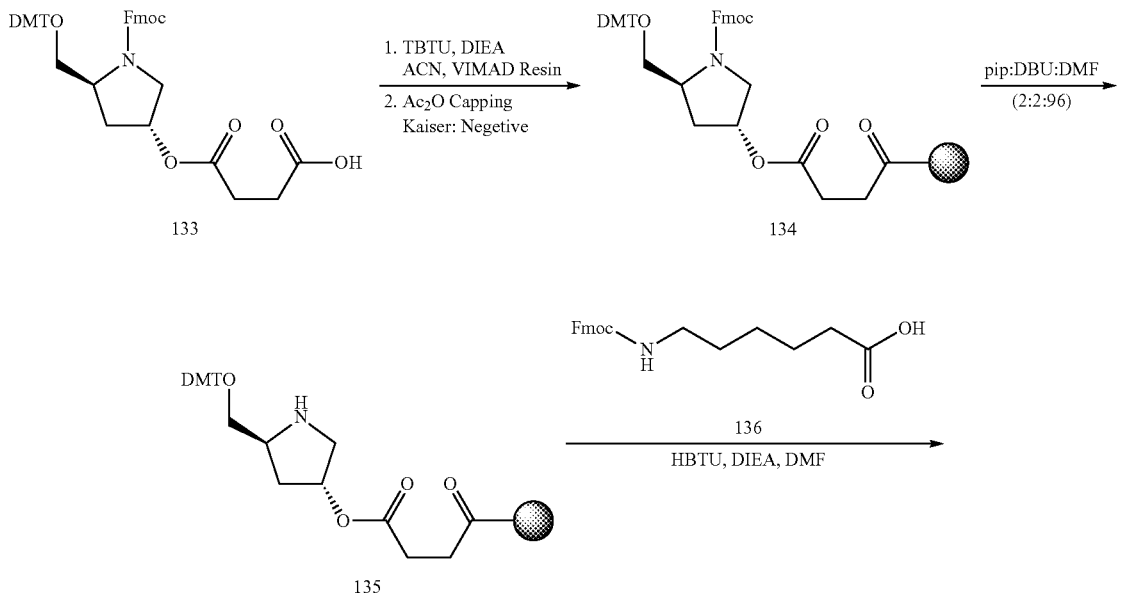

-continued
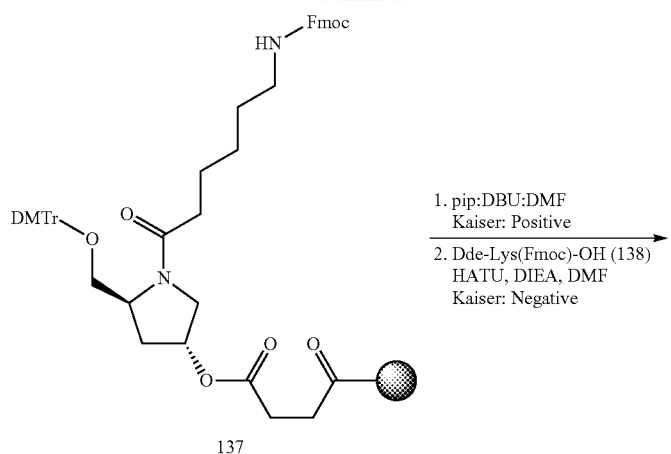
137
1. pip:DBU:DMF
   Kaiser: Positive
2. Dde-Lys(Fmoc)-OH (138)
   HATU, DIEA, DMF
   Kaiser: Negative
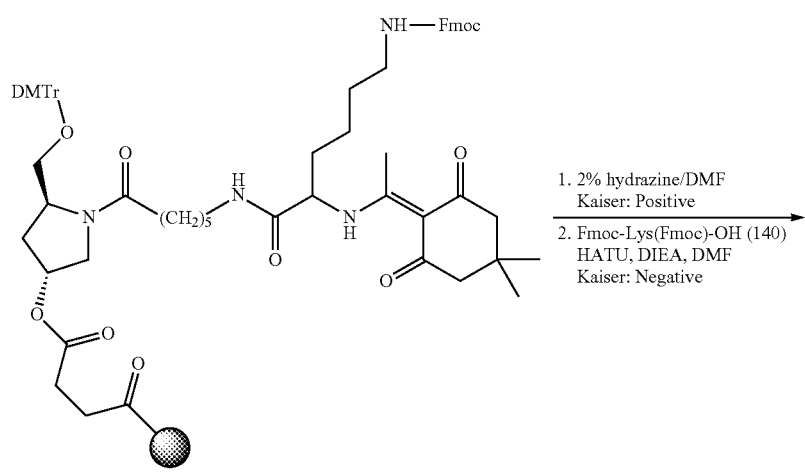
139
1. 2% hydrazine/DMF
   Kaiser: Positive
2. Fmoc-Lys(Fmoc)-OH (140)
   HATU, DIEA, DMF
   Kaiser: Negative
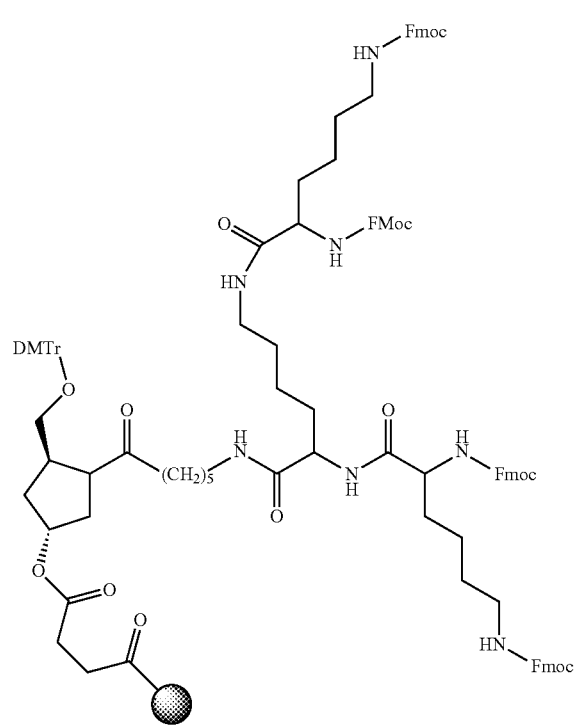
141

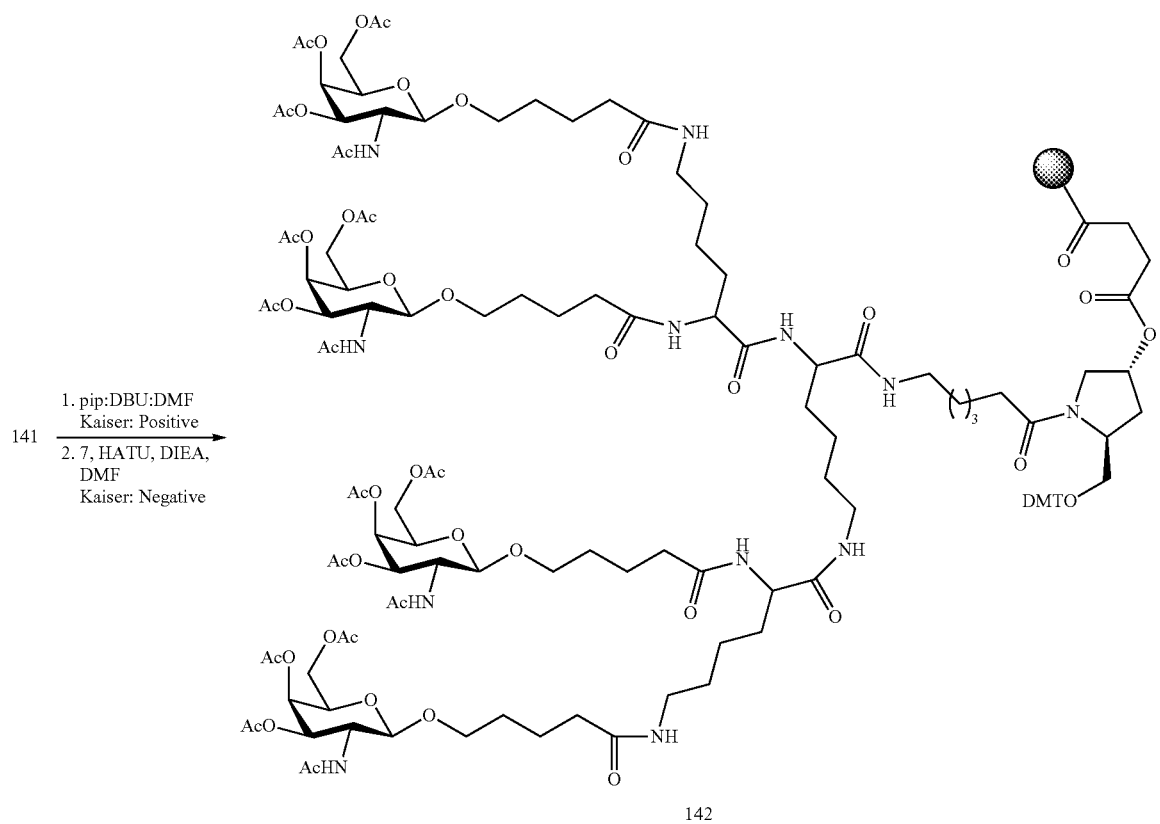

Synthesis of Compound 134. To a Merrifield flask was added aminomethyl VIMAD resin (2.5 g, 450 µmol/g) that was washed with acetonitrile, dimethylformamide, dichloromethane and acetonitrile. The resin was swelled in acetonitrile (4 mL). Compound 133 was pre-activated in a 100 mL round bottom flask by adding 20 (1.0 mmol, 0.747 g), TBTU (1.0 mmol, 0.321 g), acetonitrile (5 mL) and DIEA (3.0 mmol, 0.5 mL). This solution was allowed to stir for 5 min and was then added to the Merrifield flask with shaking. The suspension was allowed to shake for 3 h. The reaction mixture was drained and the resin was washed with acetonitrile, DMF and DCM. New resin loading was quantitated by measuring the absorbance of the DMT cation at 500 nm (extinction coefficient=76000) in DCM and determined to be 238 µmol/g. The resin was capped by suspending in an acetic anhydride solution for ten minutes three times.

The solid support bound compound 141 was synthesized using iterative Fmoc-based solid phase peptide synthesis methods. A small amount of solid support was withdrawn and suspended in aqueous ammonia (28-30 wt %) for 6 h. The cleaved compound was analyzed by LC-MS and the observed mass was consistent with structure. Mass m/z 1063.8 [M+2H]$^+$.

The solid support bound compound 142 was synthesized using solid phase peptide synthesis methods.

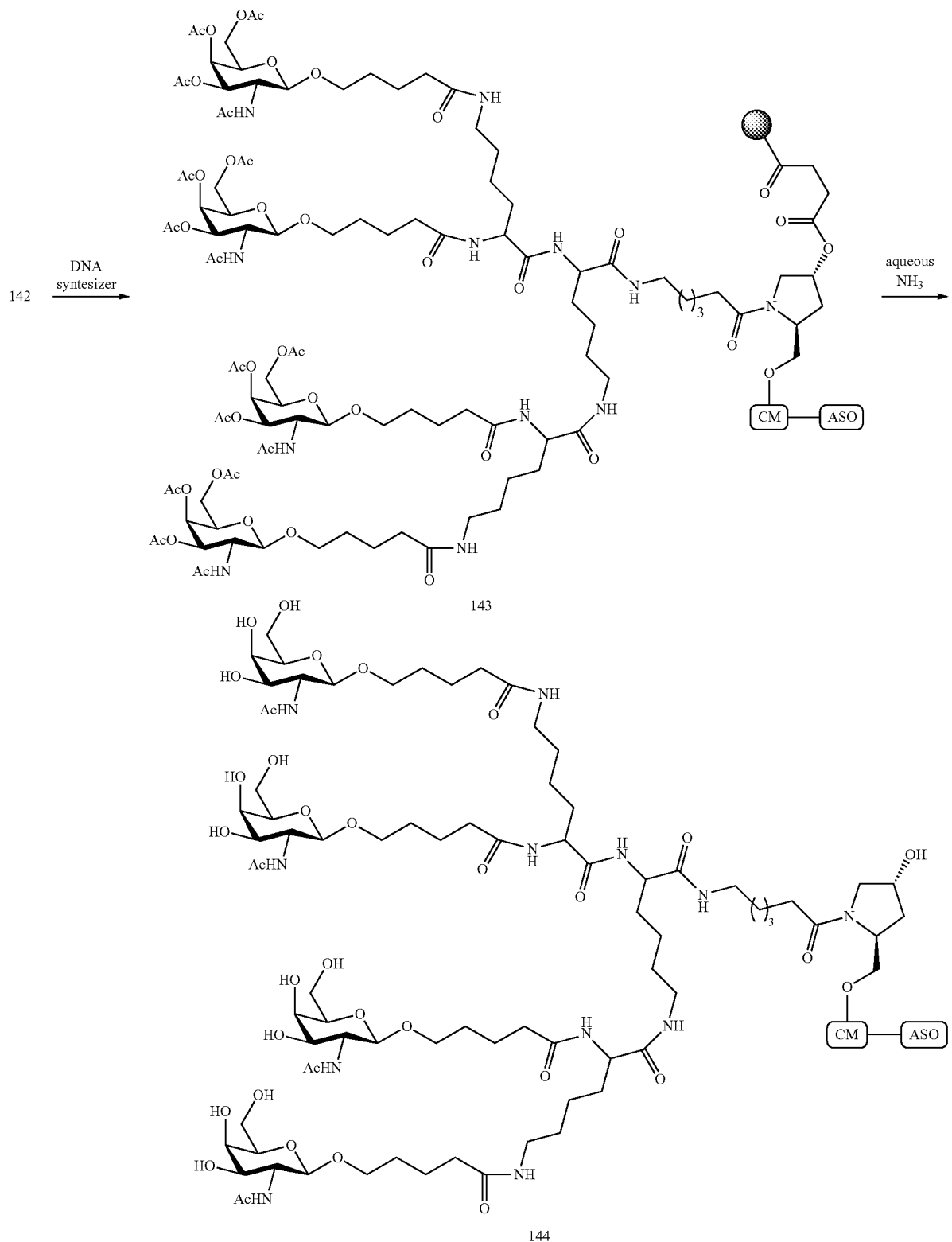

The solid support bound compound 143 was synthesized using standard solid phase synthesis on a DNA synthesizer.

The solid support bound compound 143 was suspended in aqueous ammonia (28-30 wt %) and heated at 55° C. for 16 h. The solution was cooled and the solid support was filtered. The filtrate was concentrated and the residue dissolved in water and purified by HPLC on a strong anion exchange column. The fractions containing full length compound 144 were pooled together and desalted. The resulting GalNAc$_4$-11 conjugated oligomeric compound was analyzed by LC-MS and the observed mass was consistent with structure.

The GalNAc$_4$ cluster portion of the conjugate group Gal-NAc$_4$-11 (GalNAc$_4$-11$_a$) can be combined with any cleavable moiety to provide a variety of conjugate groups. In certain embodiments, the cleavable moiety is —P(=O)(OH)-A$_d$-P(=O)(OH)—.

The structure of GalNAc$_4$-11 (GalNAc$_4$-11$_a$-CM) is shown below:

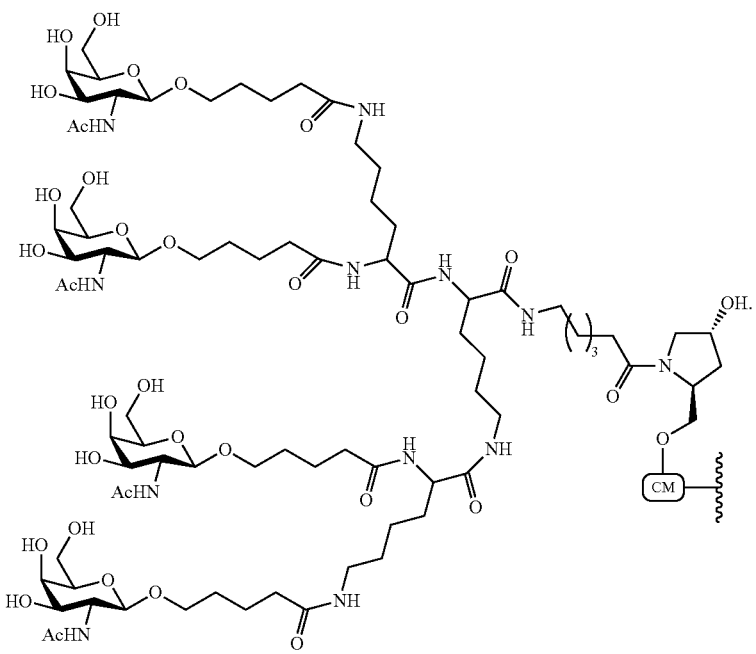

Example 51

Preparation of Oligonucleotide 155 Comprising GalNAc$_3$-6

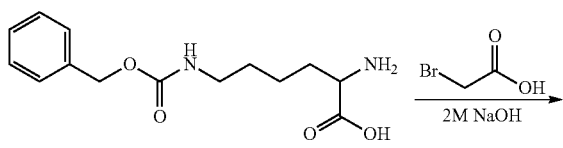

145

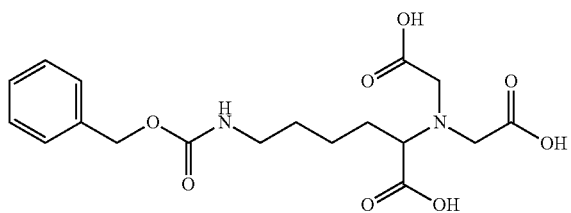

146

Compound 146 was synthesized as described in the literature (*Analytical Biochemistry* 1995, 229, 54-60).

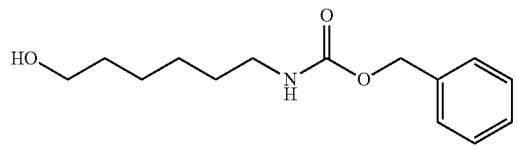

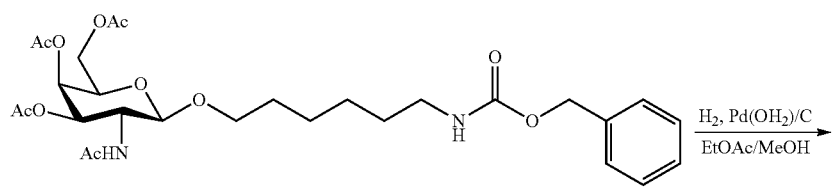

112

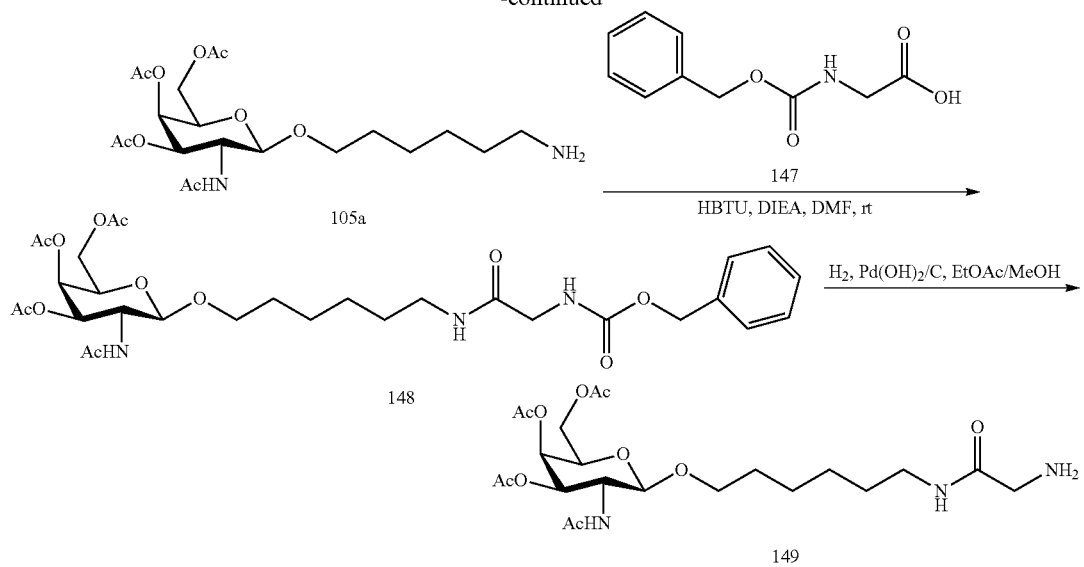

Compound 4 (15 g, 45.55 mmol) and compound 35b (14.3 grams, 57 mmol) were dissolved in CH$_2$Cl$_2$ (200 ml). Activated molecular sieves (4 Å, 2 g, powdered) were added, and the reaction was allowed to stir for 30 minutes under nitrogen atmosphere. TMS-OTf was added (4.1 ml, 22.77 mmol) and the reaction was allowed to stir at room temp overnight. Upon completion, the reaction was quenched by pouring into solution of saturated aqueous NaHCO$_3$ (500 ml) and crushed ice (~150 g). The organic layer was separated, washed with brine, dried over MgSO$_4$, filtered, and was concentrated to an orange oil under reduced pressure. The crude material was purified by silica gel column chromatography and eluted with 2-10% MeOH in CH$_2$Cl$_2$ to yield Compound 112 (16.53 g, 63%). LCMS and $^1$H NMR were consistent with the expected compound.

Compound 112 (4.27 g, 7.35 mmol) was dissolved in 1:1 MeOH/EtOAc (40 ml). The reaction mixture was purged by bubbling a stream of argon through the solution for 15 minutes. Pearlman's catalyst (palladium hydroxide on carbon, 400 mg) was added, and hydrogen gas was bubbled through the solution for 30 minutes. Upon completion (TLC 10% MeOH in CH$_2$Cl$_2$, and LCMS), the catalyst was removed by filtration through a pad of celite. The filtrate was concentrated by rotary evaporation, and was dried briefly under high vacuum to yield Compound 105a (3.28 g). LCMS and 1H NMR were consistent with desired product.

Compound 147 (2.31 g, 11 mmol) was dissolved in anhydrous DMF (100 mL). N,N-Diisopropylethylamine (DIEA, 3.9 mL, 22 mmol) was added, followed by HBTU (4 g, 10.5 mmol). The reaction mixture was allowed to stir for ~15 minutes under nitrogen. To this a solution of compound 105a (3.3 g, 7.4 mmol) in dry DMF was added and stirred for 2 h under nitrogen atmosphere. The reaction was diluted with EtOAc and washed with saturated aqueous NaHCO$_3$ and brine. The organics phase was separated, dried (MgSO$_4$), filtered, and concentrated to an orange syrup. The crude material was purified by column chromatography 2-5% MeOH in CH$_2$Cl$_2$ to yield Compound 148 (3.44 g, 73%). LCMS and $^1$H NMR were consistent with the expected product.

Compound 148 (3.3 g, 5.2 mmol) was dissolved in 1:1 MeOH/EtOAc (75 ml). The reaction mixture was purged by bubbling a stream of argon through the solution for 15 minutes. Pearlman's catalyst (palladium hydroxide on carbon) was added (350 mg). Hydrogen gas was bubbled through the solution for 30 minutes. Upon completion (TLC 10% MeOH in DCM, and LCMS), the catalyst was removed by filtration through a pad of celite. The filtrate was concentrated by rotary evaporation, and was dried briefly under high vacuum to yield Compound 149 (2.6 g). LCMS was consistent with desired product. The residue was dissolved in dry DMF (10 ml) was used immediately in the next step.

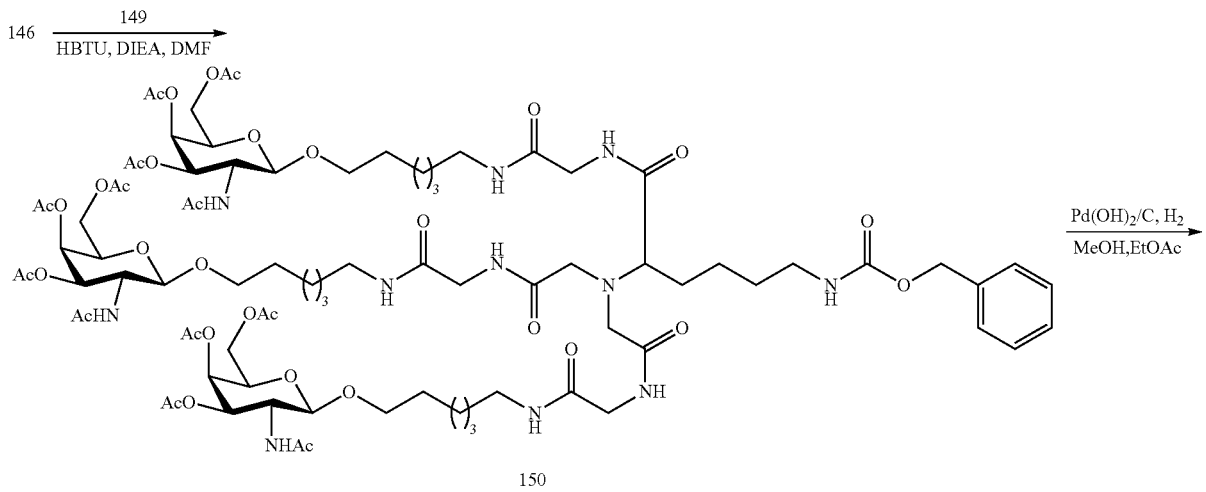

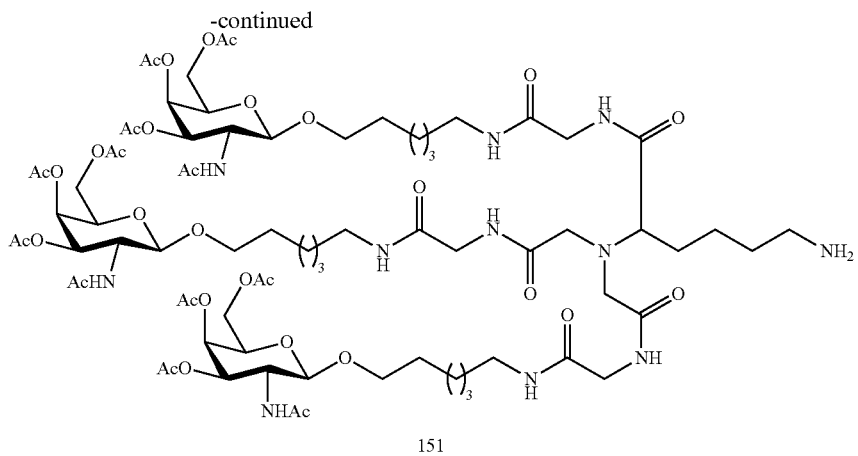

151

Compound 146 (0.68 g, 1.73 mmol) was dissolved in dry DMF (20 ml). To this DIEA (450 µL, 2.6 mmol, 1.5 eq.) and HBTU (1.96 g, 0.5.2 mmol) were added. The reaction mixture was allowed to stir for 15 minutes at room temperature under nitrogen. A solution of compound 149 (2.6 g) in anhydrous DMF (10 mL) was added. The pH of the reaction was adjusted to pH=9-10 by addition of DIEA (if necessary). The reaction was allowed to stir at room temperature under nitrogen for 2 h. Upon completion the reaction was diluted with EtOAc (100 mL), and washed with aqueous saturated aqueous NaHCO₃, followed by brine. The organic phase was separated, dried over MgSO₄, filtered, and concentrated. The residue was purified by silica gel column chromatography and eluted with 2-10% MeOH in CH₂Cl₂ to yield Compound 150 (0.62 g, 20%). LCMS and ¹H NMR were consistent with the desired product.

Compound 150 (0.62 g) was dissolved in 1:1 MeOH/EtOAc (5 L). The reaction mixture was purged by bubbling a stream of argon through the solution for 15 minutes. Pearlman's catalyst (palladium hydroxide on carbon) was added (60 mg). Hydrogen gas was bubbled through the solution for 30 minutes. Upon completion (TLC 10% MeOH in DCM, and LCMS), the catalyst was removed by filtration (syringe-tip Teflon filter, 0.45 µL). The filtrate was concentrated by rotary evaporation, and was dried briefly under high vacuum to yield Compound 151 (0.57 g). The LCMS was consistent with the desired product. The product was dissolved in 4 mL dry DMF and was used immediately in the next step.

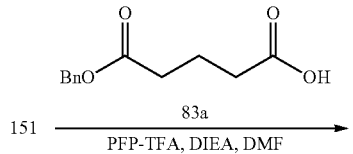

151 →(83a / PFP-TFA, DIEA, DMF)

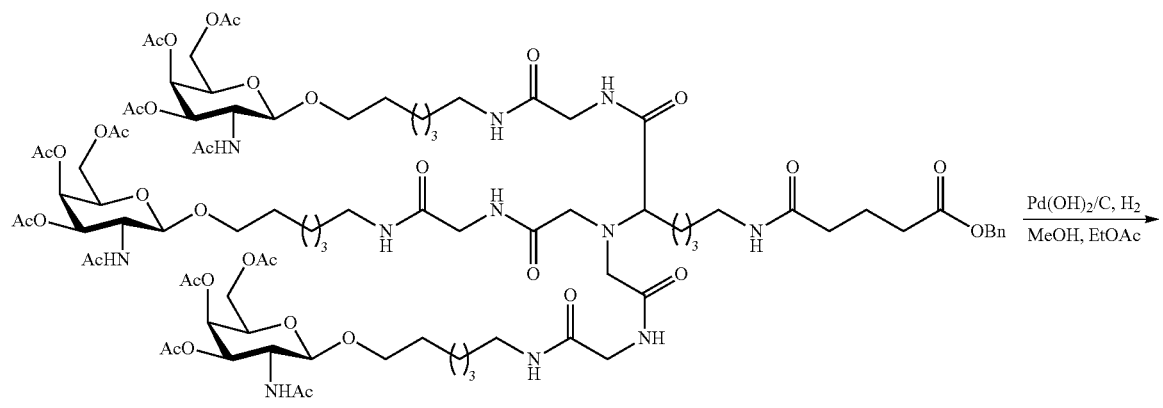

152

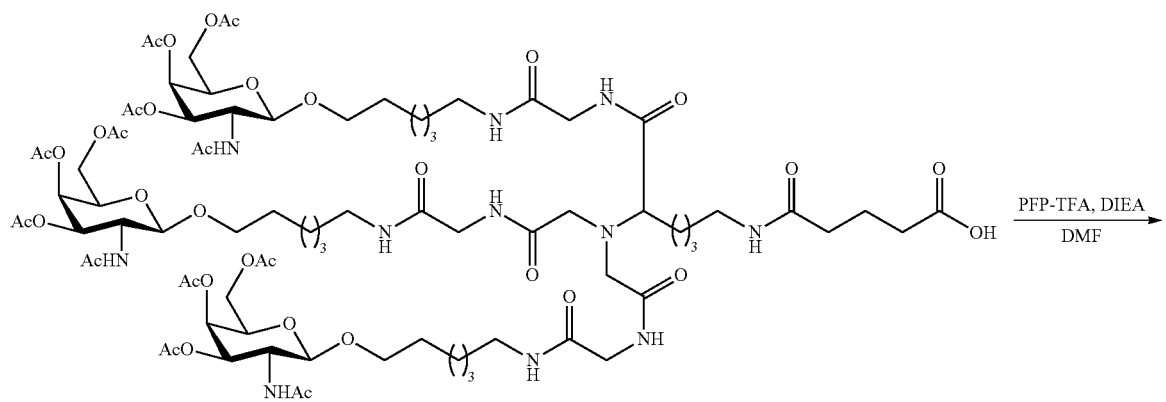

153

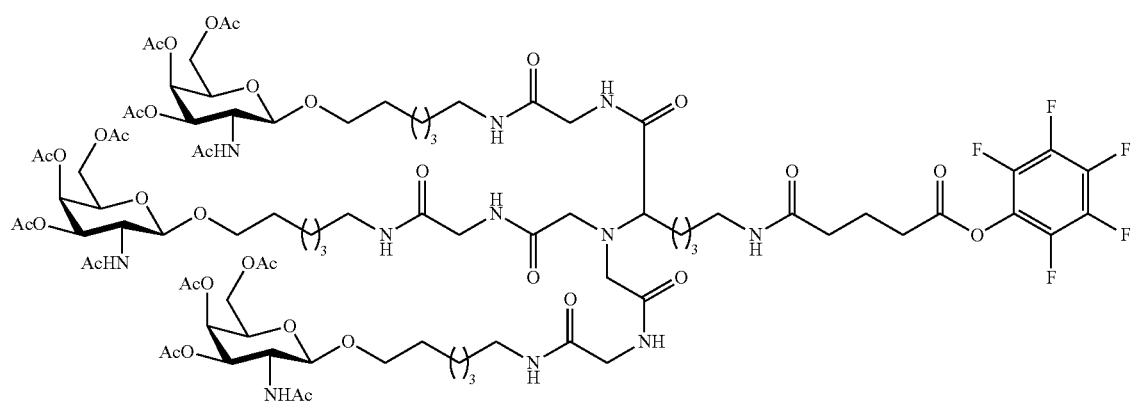

154

Compound 83a (0.11 g, 0.33 mmol) was dissolved in anhydrous DMF (5 mL) and N,N-Diisopropylethylamine (75 µL, 1 mmol) and PFP-TFA (90 µL, 0.76 mmol) were added. The reaction mixture turned magenta upon contact, and gradually turned orange over the next 30 minutes. Progress of reaction was monitored by TLC and LCMS. Upon completion (formation of the PFP ester), a solution of compound 151 (0.57 g, 0.33 mmol) in DMF was added. The pH of the reaction was adjusted to pH=9-10 by addition of N,N-Diisopropylethylamine (if necessary). The reaction mixture was stirred under nitrogen for ~30 min Upon completion, the majority of the solvent was removed under reduced pressure. The residue was diluted with $CH_2Cl_2$ and washed with aqueous saturated $NaHCO_3$, followed by brine. The organic phase separated, dried over $MgSO_4$, filtered, and concentrated to an orange syrup. The residue was purified by silica gel column chromatography (2-10% MeOH in $CH_2Cl_2$) to yield Compound 152 (0.35 g, 55%). LCMS and $^1$H NMR were consistent with the desired product.

Compound 152 (0.35 g, 0.182 mmol) was dissolved in 1:1 MeOH/EtOAc (10 mL). The reaction mixture was purged by bubbling a stream of argon thru the solution for 15 minutes. Pearlman's catalyst (palladium hydroxide on carbon) was added (35 mg). Hydrogen gas was bubbled thru the solution for 30 minutes. Upon completion (TLC 10% MeOH in DCM, and LCMS), the catalyst was removed by filtration (syringe-tip Teflon filter, 0.45 µm). The filtrate was concentrated by rotary evaporation, and was dried briefly under high vacuum to yield Compound 153 (0.33 g, quantitative). The LCMS was consistent with desired product.

Compound 153 (0.33 g, 0.18 mmol) was dissolved in anhydrous DMF (5 mL) with stirring under nitrogen. To this N,N-Diisopropylethylamine (65 µL, 0.37 mmol) and PFP-TFA (35 µL, 0.28 mmol) were added. The reaction mixture was stirred under nitrogen for ~30 min. The reaction mixture turned magenta upon contact, and gradually turned orange. The pH of the reaction mixture was maintained at pH=9-10 by adding more N,-Diisopropylethylamine. The progress of the reaction was monitored by TLC and LCMS. Upon completion, the majority of the solvent was removed under reduced pressure. The residue was diluted with $CH_2Cl_2$ (50 mL), and washed with saturated aqueous $NaHCO_3$, followed by brine. The organic layer was dried over $MgSO_4$, filtered, and concentrated to an orange syrup. The residue was purified by column chromatography and eluted with 2-10% MeOH in $CH_2Cl_2$ to yield Compound 154 (0.29 g, 79%). LCMS and $^1$H NMR were consistent with the desired product.

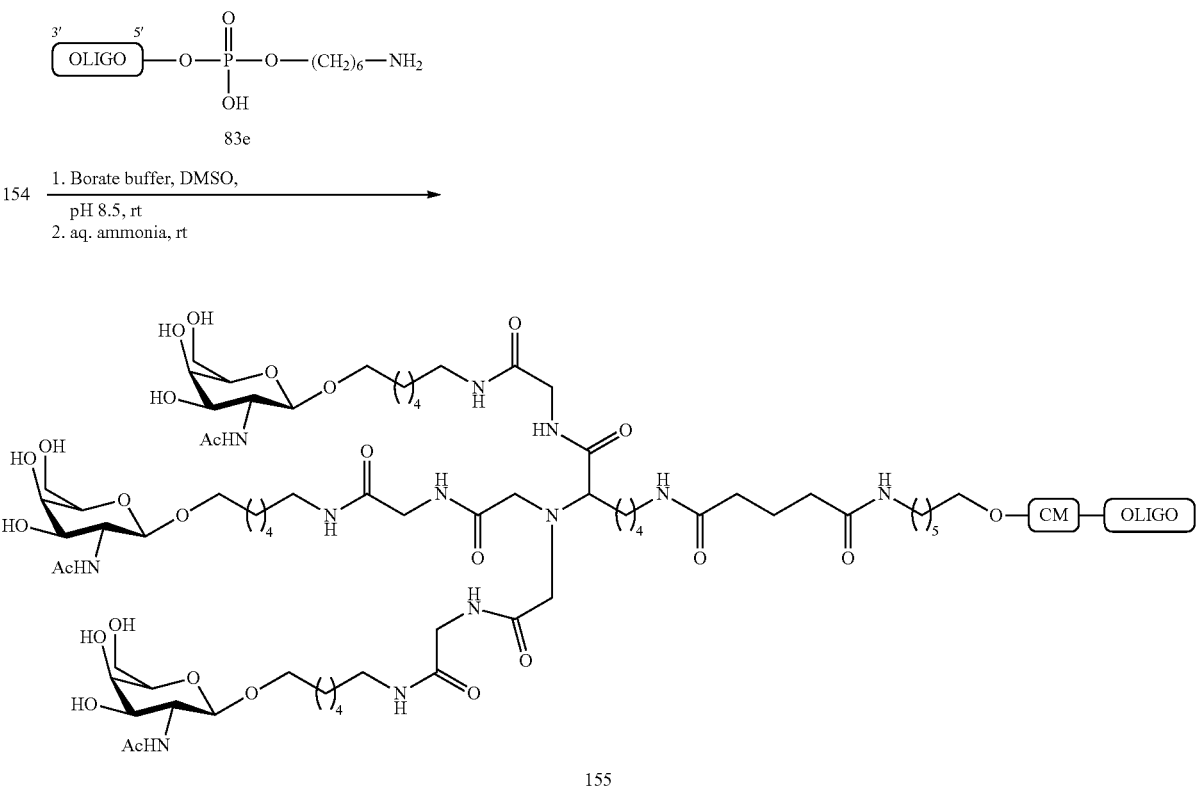

Oligomeric Compound 155, comprising a GalNAc$_3$-6 conjugate group, was prepared using the general procedures illustrated in Example 46. The GalNAc$_3$ cluster portion of the conjugate group GalNAc$_3$-6 (GalNAc$_3$-6$_a$) can be combined with any cleavable moiety to provide a variety of conjugate groups. In certain embodiments, the cleavable moiety is —P(=O)(OH)-A$_d$-P(=O)(OH)—.

The structure of GalNAc$_3$-6 (GalNAc$_3$-6$_a$-CM-) is shown below:

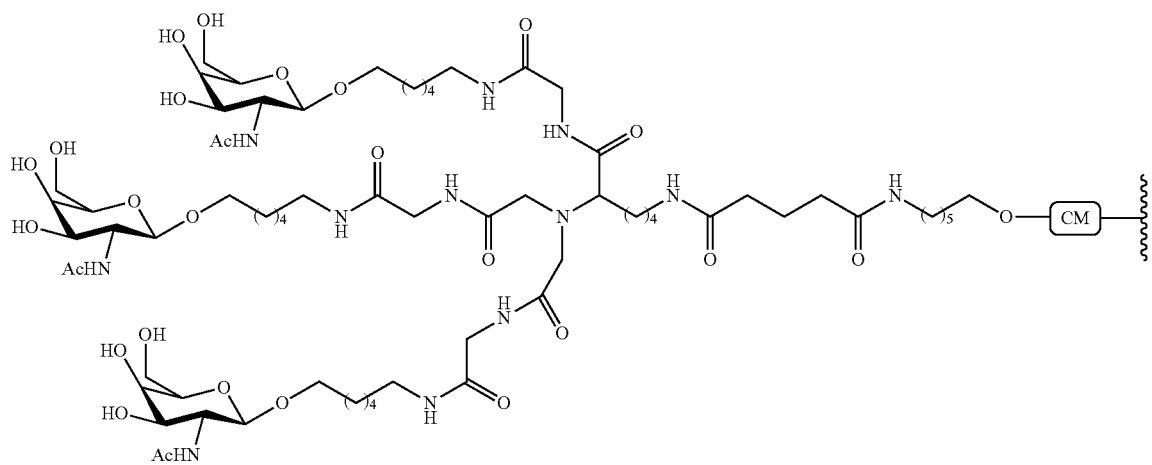

Example 52

Preparation of Oligonucleotide 160 Comprising GalNAc$_3$-9

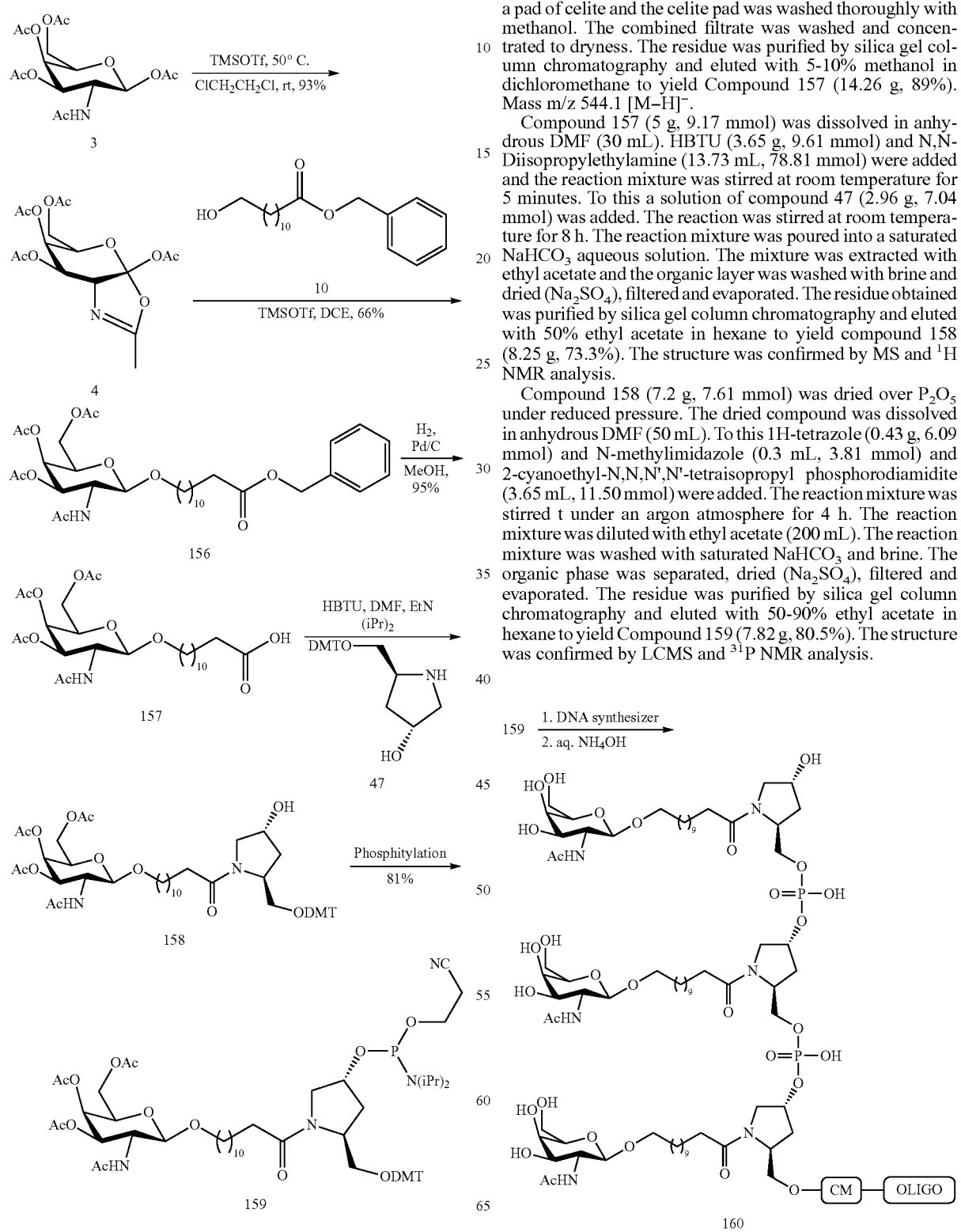

Compound 156 was synthesized following the procedure described in the literature (*J. Med. Chem.* 2004, 47, 5798-5808).

Compound 156, (18.60 g, 29.28 mmol) was dissolved in methanol (200 mL). Palladium on carbon (6.15 g, 10 wt %, loading (dry basis), matrix carbon powder, wet) was added. The reaction mixture was stirred at room temperature under hydrogen for 18 h. The reaction mixture was filtered through a pad of celite and the celite pad was washed thoroughly with methanol. The combined filtrate was washed and concentrated to dryness. The residue was purified by silica gel column chromatography and eluted with 5-10% methanol in dichloromethane to yield Compound 157 (14.26 g, 89%). Mass m/z 544.1 [M–H]$^-$.

Compound 157 (5 g, 9.17 mmol) was dissolved in anhydrous DMF (30 mL). HBTU (3.65 g, 9.61 mmol) and N,N-Diisopropylethylamine (13.73 mL, 78.81 mmol) were added and the reaction mixture was stirred at room temperature for 5 minutes. To this a solution of compound 47 (2.96 g, 7.04 mmol) was added. The reaction was stirred at room temperature for 8 h. The reaction mixture was poured into a saturated NaHCO$_3$ aqueous solution. The mixture was extracted with ethyl acetate and the organic layer was washed with brine and dried (Na$_2$SO$_4$), filtered and evaporated. The residue obtained was purified by silica gel column chromatography and eluted with 50% ethyl acetate in hexane to yield compound 158 (8.25 g, 73.3%). The structure was confirmed by MS and $^1$H NMR analysis.

Compound 158 (7.2 g, 7.61 mmol) was dried over P$_2$O$_5$ under reduced pressure. The dried compound was dissolved in anhydrous DMF (50 mL). To this 1H-tetrazole (0.43 g, 6.09 mmol) and N-methylimidazole (0.3 mL, 3.81 mmol) and 2-cyanoethyl-N,N,N',N'-tetraisopropyl phosphorodiamidite (3.65 mL, 11.50 mmol) were added. The reaction mixture was stirred t under an argon atmosphere for 4 h. The reaction mixture was diluted with ethyl acetate (200 mL). The reaction mixture was washed with saturated NaHCO$_3$ and brine. The organic phase was separated, dried (Na$_2$SO$_4$), filtered and evaporated. The residue was purified by silica gel column chromatography and eluted with 50-90% ethyl acetate in hexane to yield Compound 159 (7.82 g, 80.5%). The structure was confirmed by LCMS and $^{31}$P NMR analysis.

Oligomeric Compound 160, comprising a GalNAc$_3$-9 conjugate group, was prepared using standard oligonucleotide synthesis procedures. Three units of compound 159 were coupled to the solid support, followed by nucleotide phosphoramidites. Treatment of the protected oligomeric compound with aqueous ammonia yielded compound 160. The GalNAc$_3$ cluster portion of the conjugate group GalNAc$_3$-9 (GalNAc$_3$-9$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-9 (GalNAc$_3$-9$_a$-CM) is shown below:

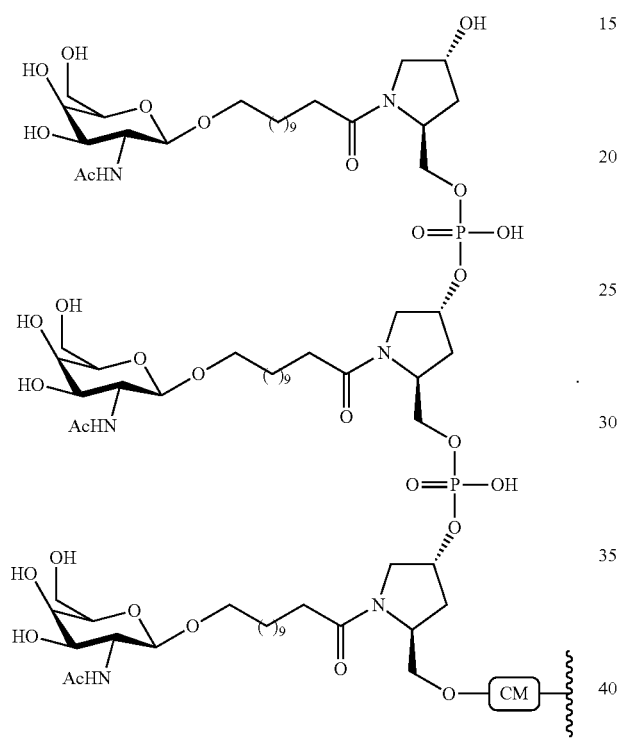

Example 53

Alternate Procedure for Preparation of Compound 18 (GalNAc$_3$-1a and GalNAc$_3$-3a)

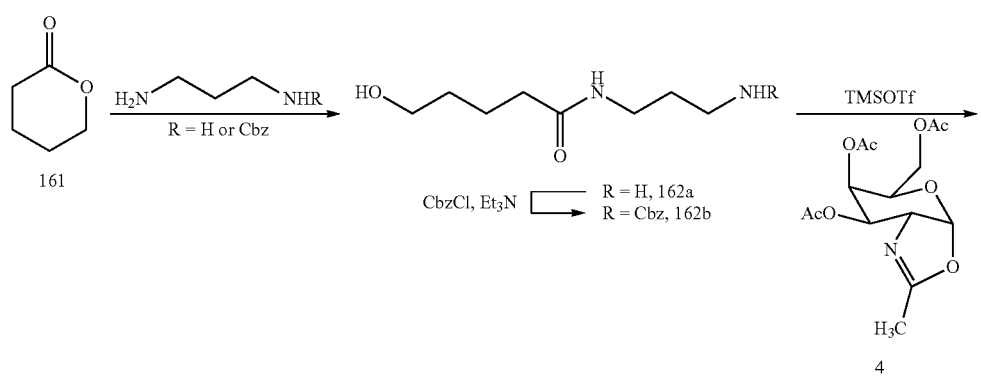

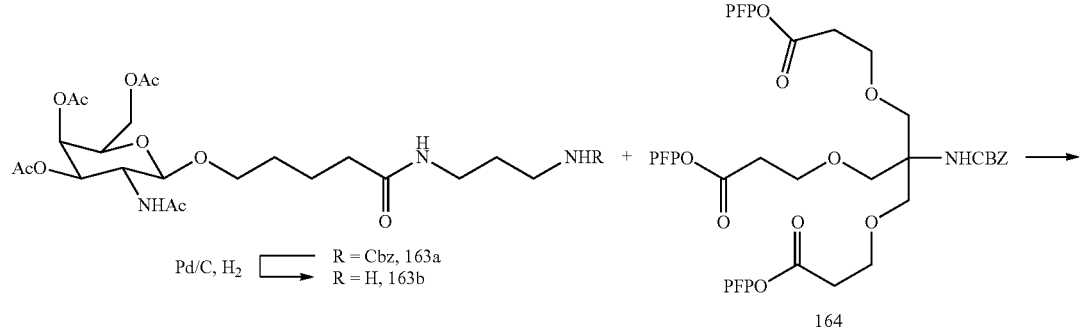

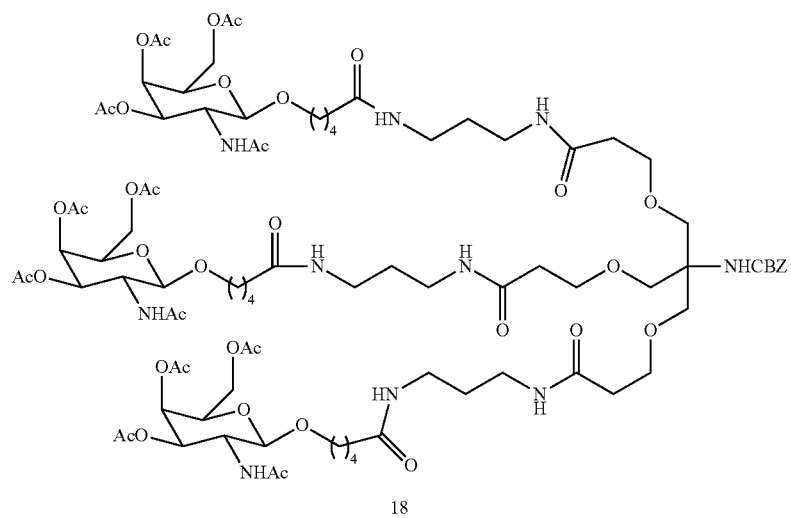

Lactone 161 was reacted with diamino propane (3-5 eq) or Mono-Boc protected diamino propane (1 eq) to provide alcohol 162a or 162b. When unprotected propanediamine was used for the above reaction, the excess diamine was removed by evaporation under high vacuum and the free amino group in 162a was protected using CbzCl to provide 162b as a white solid after purification by column chromatography. Alcohol 162b was further reacted with compound 4 in the presence of TMSOTf to provide 163a which was converted to 163b by removal of the Cbz group using catalytic hydrogenation. The pentafluorophenyl (PFP) ester 164 was prepared by reacting triacid 113 (see Example 48) with PFPTFA (3.5 eq) and pyridine (3.5 eq) in DMF (0.1 to 0.5 M). The triester 164 was directly reacted with the amine 163b (3-4 eq) and DIPEA (3-4 eq) to provide Compound 18. The above method greatly facilitates purification of intermediates and minimizes the formation of byproducts which are formed using the procedure described in Example 4.

Example 54

Alternate Procedure for Preparation of Compound 18 (GalNAc$_3$-1a and GalNAc$_3$-3a)

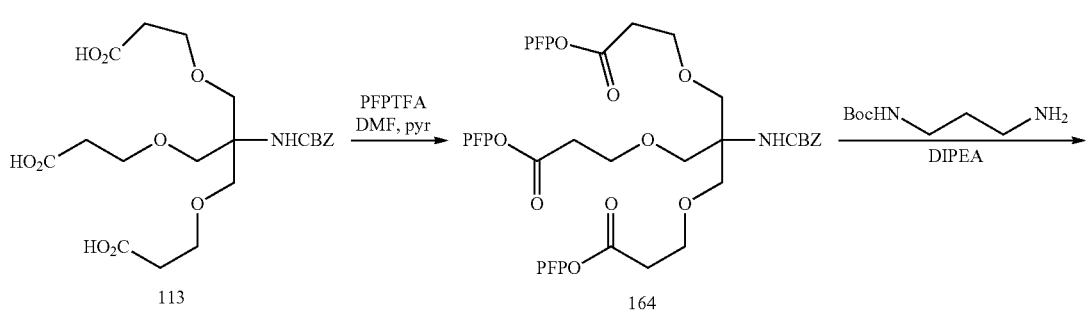

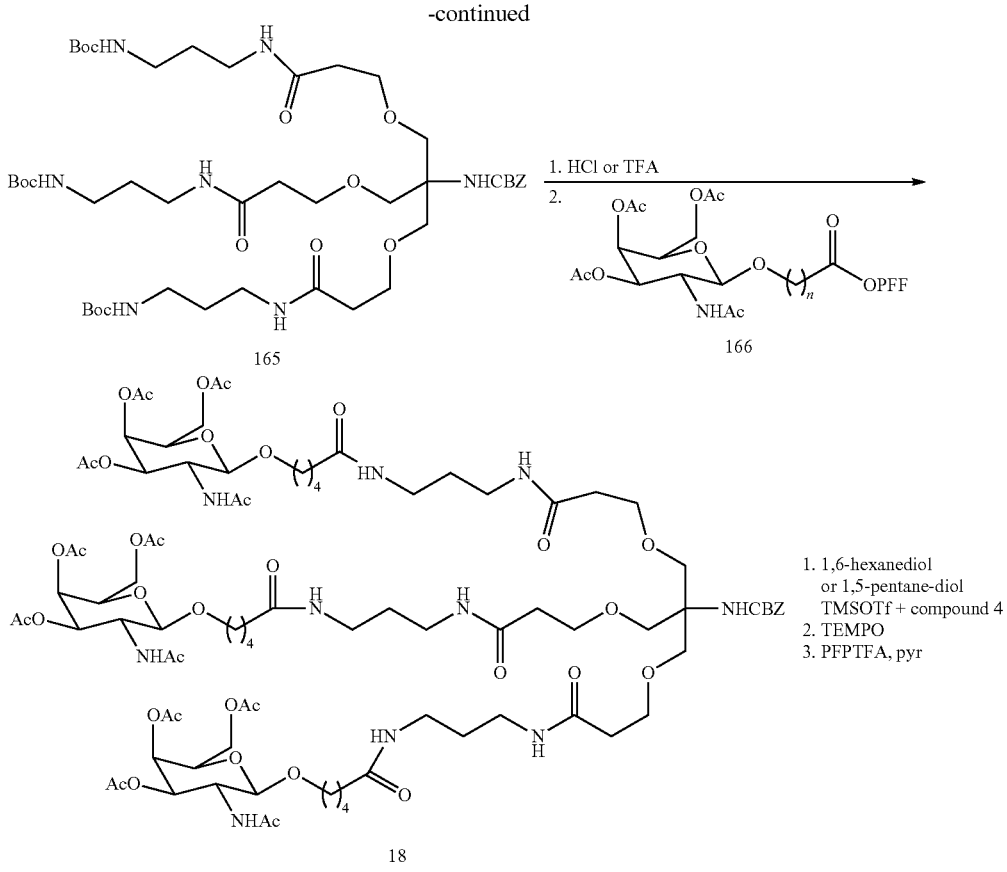

The triPFP ester 164 was prepared from acid 113 using the procedure outlined in example 53 above and reacted with mono-Boc protected diamine to provide 165 in essentially quantitative yield. The Boc groups were removed with hydrochloric acid or trifluoroacetic acid to provide the triamine which was reacted with the PFP activated acid 166 in the presence of a suitable base such as DIPEA to provide Compound 18.

The PFP protected Gal-NAc acid 166 was prepared from the corresponding acid by treatment with PFPTFA (1-1.2 eq) and pyridine (1-1.2 eq) in DMF. The precursor acid in turn was prepared from the corresponding alcohol by oxidation using TEMPO (0.2 eq) and BAIB in acetonitrile and water. The precursor alcohol was prepared from sugar intermediate 4 by reaction with 1,6-hexanediol (or 1,5-pentanediol or other diol for other n values) (2-4 eq) and TMSOTf using conditions described previously in example 47.

Example 55

Dose-Dependent Study of Oligonucleotides Comprising Either a 3′ or 5′-Conjugate Group (Comparison of $GalNAc_3$-1, 3, 8 and 9) Targeting SRB-1 In Vivo The oligonucleotides listed below were tested in a dose-dependent study for antisense inhibition of SRB-1 in mice. Unconjugated ISIS 353382 was included as a standard. Each of the various $GalNAc_3$ conjugate groups was attached at either the 3′ or 5′ terminus of the respective oligonucleotide by a phosphodiester linked 2′-deoxyadenosine nucleoside (cleavable moiety).

TABLE 39

| | Modified ASO targeting SRB-1 | | | |
|---|---|---|---|---|
| ASO | Sequence (5′ to 3′) | Motif | Conjugate | SEQ ID No. |
| ISIS 353382 (parent) | $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_e$ | 5/10/5 | none | 4886 |
| ISIS 655861 | $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_{eo}A_{do'}$-$GalNAc_3$-$1_a$ | 5/10/5 | $GalNAc_3$-1 | 4887 |
| ISIS 664078 | $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_{eo}A_{do'}$-$GalNAc_3$-$9_a$ | 5/10/5 | $GalNAc_3$-9 | 4887 |
| ISIS 661161 | $GalNAc_3$-$3_{a'\text{-}o'}A_{do}$ $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_e$ | 5/10/5 | $GalNAc_3$-3 | 4888 |

TABLE 39-continued

Modified ASO targeting SRB-1

| ASO | Sequence (5' to 3') | Motif | Conjugate | SEQ ID No. |
|---|---|---|---|---|
| ISIS 665001 | GalNAc$_3$-8$_{a'o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-8 | 4888 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-9 was shown previously in Example 52. The structure of GalNAc$_3$-3 was shown previously in Example 39. The structure of GalNAc$_3$-8 was shown previously in Example 47.

Treatment

Six week old male Balb/c mice (Jackson Laboratory, Bar Harbor, Me.) were injected subcutaneously once at the dosage shown below with ISIS 353382, 655861, 664078, 661161, 665001 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 40, treatment with antisense oligonucleotides lowered SRB-1 mRNA levels in a dose-dependent manner. Indeed, the antisense oligonucleotides comprising the phosphodiester linked GalNAc$_3$-1 and GalNAc$_3$-9 conjugates at the 3' terminus (ISIS 655861 and ISIS 664078) and the GalNAc$_3$-3 and GalNAc$_3$-8 conjugates linked at the 5' terminus (ISIS 661161 and ISIS 665001) showed substantial improvement in potency compared to the unconjugated antisense oligonucleotide (ISIS 353382). Furthermore, ISIS 664078, comprising a GalNAc$_3$-9 conjugate at the 3' terminus was essentially equipotent compared to ISIS 655861, which comprises a GalNAc$_3$-1 conjugate at the 3' terminus. The 5' conjugated antisense oligonucleotides, ISIS 661161 and ISIS 665001, comprising a GalNAc$_3$-3 or GalNAc$_3$-9, respectively, had increased potency compared to the 3' conjugated antisense oligonucleotides (ISIS 655861 and ISIS 664078).

TABLE 40

ASOs containing GalNAc$_3$-1, 3, 8 or 9 targeting SRB-1

| ISIS No. | Dosage (mg/kg) | SRB-1 mRNA (% Saline) | Conjugate |
|---|---|---|---|
| Saline | n/a | 100 | |
| 353382 | 3 | 88 | none |
| | 10 | 68 | |
| | 30 | 36 | |
| 655861 | 0.5 | 98 | GalNac$_3$-1 (3') |
| | 1.5 | 76 | |
| | 5 | 31 | |
| | 15 | 20 | |
| 664078 | 0.5 | 88 | GalNac$_3$-9 (3') |
| | 1.5 | 85 | |
| | 5 | 46 | |
| | 15 | 20 | |
| 661161 | 0.5 | 92 | GalNac$_3$-3 (5') |
| | 1.5 | 59 | |
| | 5 | 19 | |
| | 15 | 11 | |
| 665001 | 0.5 | 100 | GalNac$_3$-8 (5') |
| | 1.5 | 73 | |
| | 5 | 29 | |
| | 15 | 13 | |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in the table below.

TABLE 41

| ISIS No. | Dosage mg/kg | ALT | AST | Total Bilirubin | BUN | Conjugate |
|---|---|---|---|---|---|---|
| Saline | | 24 | 59 | 0.1 | 37.52 | |
| 353382 | 3 | 21 | 66 | 0.2 | 34.65 | none |
| | 10 | 22 | 54 | 0.2 | 34.2 | |
| | 30 | 22 | 49 | 0.2 | 33.72 | |
| 655861 | 0.5 | 25 | 62 | 0.2 | 30.65 | GalNac$_3$-1 (3') |
| | 1.5 | 23 | 48 | 0.2 | 30.97 | |
| | 5 | 28 | 49 | 0.1 | 32.92 | |
| | 15 | 40 | 97 | 0.1 | 31.62 | |
| 664078 | 0.5 | 40 | 74 | 0.1 | 35.3 | GalNac$_3$-9 (3') |
| | 1.5 | 47 | 104 | 0.1 | 32.75 | |
| | 5 | 20 | 43 | 0.1 | 30.62 | |
| | 15 | 38 | 92 | 0.1 | 26.2 | |
| 661161 | 0.5 | 101 | 162 | 0.1 | 34.17 | |
| | 1.5 g | 42 | 100 | 0.1 | 33.37 | GalNac$_3$-3 (5') |
| | 5 g | 23 | 99 | 0.1 | 34.97 | |
| | 15 | 53 | 83 | 0.1 | 34.8 | |
| 665001 | 0.5 | 28 | 54 | 0.1 | 31.32 | GalNac$_3$-8 (5') |
| | 1.5 | 42 | 75 | 0.1 | 32.32 | |
| | 5 | 24 | 42 | 0.1 | 31.85 | |
| | 15 | 32 | 67 | 0.1 | 31. | |

Example 56

Dose-Dependent Study of Oligonucleotides Comprising Either a 3' or 5'-Conjugate Group (Comparison of GalNAc$_3$-1, 2, 3, 5, 6, 7 and 10) Targeting SRB-1 In Vivo The oligonucleotides listed below were tested in a dose-dependent study for antisense inhibition of SRB-1 in mice. Unconjugated ISIS 353382 was included as a standard. Each of the various GalNAc$_3$ conjugate groups was attached at the 5' terminus of the respective oligonucleotide by a phosphodiester linked 2'-deoxyadenosine nucleoside (cleavable moiety) except for ISIS 655861 which had the GalNAc$_3$ conjugate group attached at the 3' terminus.

TABLE 42

Modified ASO targeting SRB-1

| ASO | Sequence (5' to 3') | Motif | Conjugate | SEQ ID No. |
|---|---|---|---|---|
| ISIS 353382 (parent) | $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_e$ | 5/10/5 | no conjugate | 4886 |
| ISIS 655861 | $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_{eo}A_{do}$-GalNAc$_3$-1$_a$ | 5/10/5 | GalNAc$_3$-1 | 4887 |
| ISIS 664507 | GalNAc$_3$-2$_{a\text{-}o'}$A$_{do}$G$_{es}{}^mC_{es}T_{es}T_{es}{}^mC_{es}A_{ds}G_{ds}T_{ds}$ ${}^mC_{ds}A_{ds}T_{ds}G_{ds}A_{ds}{}^mC_{ds}T_{ds}T_{es}{}^mC_{es}{}^mC_{es}T_{es}T_e$ | 5/10/5 | GalNAc$_3$-2 | 4888 |
| ISIS 661161 | GalNAc$_3$-3$_{a\text{-}o'}$A$_{do}$ $G_{es}{}^mC_{es}T_{es}T_{es}{}^mC_{es}A_{ds}G_{ds}T_{ds}{}^mC_{ds}A_{ds}T_{ds}G_{ds}A_{ds}$ ${}^mC_{ds}T_{ds}T_{es}{}^mC_{es}{}^mC_{es}T_{es}T_e$ | 5/10/5 | GalNAc$_3$-3 | 4888 |
| ISIS 666224 | GalNAc$_3$-5$_{a\text{-}o'}$A$_{do}$G$_{es}{}^mC_{es}T_{es}T_{es}{}^mC_{es}A_{ds}G_{ds}T_{ds}$ ${}^mC_{ds}A_{ds}T_{ds}G_{ds}A_{ds}{}^mC_{ds}T_{ds}T_{es}{}^mC_{es}{}^mC_{es}T_{es}T_e$ | 5/10/5 | GalNAc$_3$-5 | 4888 |
| ISIS 666961 | GalNAc$_3$-6$_{a\text{-}o'}$A$_{do}$G$_{es}{}^mC_{es}T_{es}T_{es}{}^mC_{es}A_{ds}G_{ds}T_{ds}$ ${}^mC_{ds}A_{ds}T_{ds}G_{ds}A_{ds}{}^mC_{ds}T_{ds}T_{es}{}^mC_{es}{}^mC_{es}T_{es}T_e$ | 5/10/5 | GalNAc$_3$-6 | 4888 |
| ISIS 666981 | GalNAc$_3$-7$_{a\text{-}o'}$A$_{do}$G$_{es}{}^mC_{es}T_{es}T_{es}{}^mC_{es}A_{ds}G_{ds}T_{ds}$ ${}^mC_{ds}A_{ds}T_{ds}G_{ds}A_{ds}{}^mC_{ds}T_{ds}T_{es}{}^mC_{es}{}^mC_{es}T_{es}T_e$ | 5/10/5 | GalNAc$_3$-7 | 4888 |
| ISIS 666881 | GalNAc$_3$-10$_{a\text{-}o'}$A$_{do}$G$_{es}{}^mC_{es}T_{es}T_{es}{}^mC_{es}A_{ds}G_{ds}T_{ds}$ ${}^mC_{ds}A_{ds}T_{ds}G_{ds}A_{ds}{}^mC_{ds}T_{ds}T_{es}{}^mC_{es}{}^mC_{es}T_{es}T_e$ | 5/10/5 | GalNAc$_3$-10 | 4888 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-2$_a$ was shown previously in Example 37. The structure of GalNAc$_3$-3$_a$ was shown previously in Example 39. The structure of GalNAc$_3$-5$_a$ was shown previously in Example 49. The structure of GalNAc$_3$-6$_a$ was shown previously in Example 51. The structure of GalNAc$_3$-7$_a$ was shown previously in Example 48. The structure of GalNAc$_3$-10$_a$ was shown previously in Example 46.

Treatment

Six week old male Balb/c mice (Jackson Laboratory, Bar Harbor, Me.) were injected subcutaneously once at the dosage shown below with ISIS 353382, 655861, 664507, 661161, 666224, 666961, 666981, 666881 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 43, treatment with antisense oligonucleotides lowered SRB-1 mRNA levels in a dose-dependent manner. Indeed, the conjugated antisense oligonucleotides showed substantial improvement in potency compared to the unconjugated antisense oligonucleotide (ISIS 353382). The 5' conjugated antisense oligonucleotides showed a slight increase in potency compared to the 3' conjugated antisense oligonucleotide.

TABLE 43

| ISIS No. | Dosage (mg/kg) | SRB-1 mRNA (% Saline) | Conjugate |
|---|---|---|---|
| Saline | n/a | 100.0 | |
| 353382 | 3 | 96.0 | none |
| | 10 | 73.1 | |
| | 30 | 36.1 | |

TABLE 43-continued

| ISIS No. | Dosage (mg/kg) | SRB-1 mRNA (% Saline) | Conjugate |
|---|---|---|---|
| 655861 | 0.5 | 99.4 | GalNac$_3$-1 (3') |
| | 1.5 | 81.2 | |
| | 5 | 33.9 | |
| | 15 | 15.2 | |
| 664507 | 0.5 | 102.0 | GalNac$_3$-2 (5') |
| | 1.5 | 73.2 | |
| | 5 | 31.3 | |
| | 15 | 10.8 | |
| 661161 | 0.5 | 90.7 | GalNac$_3$-3 (5') |
| | 1.5 | 67.6 | |
| | 5 | 24.3 | |
| | 15 | 11.5 | |
| 666224 | 0.5 | 96.1 | GalNac$_3$-5 (5') |
| | 1.5 | 61.6 | |
| | 5 | 25.6 | |
| | 15 | 11.7 | |
| 666961 | 0.5 | 85.5 | GalNAc$_3$-6 (5') |
| | 1.5 | 56.3 | |
| | 5 | 34.2 | |
| | 15 | 13.1 | |
| 666981 | 0.5 | 84.7 | GalNAc$_3$-7 (5') |
| | 1.5 | 59.9 | |
| | 5 | 24.9 | |
| | 15 | 8.5 | |
| 666881 | 0.5 | 100.0 | GalNAc$_3$-10 (5') |
| | 1.5 | 65.8 | |
| | 5 | 26.0 | |
| | 15 | 13.0 | |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 44 below.

TABLE 44

| ISIS No. | Dosage mg/kg | ALT | AST | Total Bilirubin | BUN | Conjugate |
|---|---|---|---|---|---|---|
| Saline | | 26 | 57 | 0.2 | 27 | |
| 353382 | 3 | 25 | 92 | 0.2 | 27 | none |
| | 10 | 23 | 40 | 0.2 | 25 | |
| | 30 | 29 | 54 | 0.1 | 28 | |

TABLE 44-continued

| ISIS No. | Dosage mg/kg | ALT | AST | Total Bilirubin | BUN | Conjugate |
|---|---|---|---|---|---|---|
| 655861 | 0.5 | 25 | 71 | 0.2 | 34 | GalNac$_3$-1 (3') |
|  | 1.5 | 28 | 60 | 0.2 | 26 |  |
|  | 5 | 26 | 63 | 0.2 | 28 |  |
|  | 15 | 25 | 61 | 0.2 | 28 |  |
| 664507 | 0.5 | 25 | 62 | 0.2 | 25 | GalNac$_3$-2 (5') |
|  | 1.5 | 24 | 49 | 0.2 | 26 |  |
|  | 5 | 21 | 50 | 0.2 | 26 |  |
|  | 15 | 59 | 84 | 0.1 | 22 |  |
| 661161 | 0.5 | 20 | 42 | 0.2 | 29 | GalNac$_3$-3 (5') |
|  | 1.5 g | 37 | 74 | 0.2 | 25 |  |
|  | 5 g | 28 | 61 | 0.2 | 29 |  |
|  | 15 | 21 | 41 | 0.2 | 25 |  |
| 666224 | 0.5 | 34 | 48 | 0.2 | 21 | GalNac$_3$-5 (5') |
|  | 1.5 | 23 | 46 | 0.2 | 26 |  |
|  | 5 | 24 | 47 | 0.2 | 23 |  |
|  | 15 | 32 | 49 | 0.1 | 26 |  |
| 666961 | 0.5 | 17 | 63 | 0.2 | 26 | GalNac$_3$-6 (5') |
|  | 1.5 | 23 | 68 | 0.2 | 26 |  |
|  | 5 | 25 | 66 | 0.2 | 26 |  |
|  | 15 | 29 | 107 | 0.2 | 28 |  |
| 6669815 | 0.5 | 24 | 48 | 0.2 | 26 | GalNac$_3$-7 (5') |
|  | 1.5 | 30 | 55 | 0.2 | 24 |  |
|  | 5 | 46 | 74 | 0.1 | 24 |  |
|  | 15 | 29 | 58 | 0.1 | 26 |  |
| 6668815 | 0.5 | 20 | 65 | 0.2 | 27 | GalNac$_3$-10 (5') |
|  | 1.5 | 23 | 59 | 0.2 | 24 |  |
|  | 5 | 45 | 70 | 0.2 | 26 |  |
|  | 15 | 21 | 57 | 0.2 | 24 |  |

TABLE 46

ApoC III mRNA (% Saline on Day 1) and Plasma TG Levels (% Saline on Day 1)

| ASO | Dose | Target | Day 3 | Day 7 | Day 14 | Day 35 | Day 42 |
|---|---|---|---|---|---|---|---|
| Saline | 0 mg/kg | ApoC-III | 98 | 100 | 100 | 95 | 116 |
| ISIS 304801 | 30 mg/kg | ApoC-III | 28 | 30 | 41 | 65 | 74 |
| ISIS 647535 | 10 mg/kg | ApoC-III | 16 | 19 | 25 | 74 | 94 |
| ISIS 647536 | 10 mg/kg | ApoC-III | 18 | 16 | 17 | 35 | 51 |
| Saline | 0 mg/kg | Plasma TG | 121 | 130 | 123 | 105 | 109 |
| ISIS 304801 | 30 mg/kg | Plasma TG | 34 | 37 | 50 | 69 | 69 |
| ISIS 647535 | 10 mg/kg | Plasma TG | 18 | 14 | 24 | 18 | 71 |
| ISIS 647536 | 10 mg/kg | Plasma TG | 21 | 19 | 15 | 32 | 35 |

As can be seen in the table above the duration of action increased with addition of the 3'-conjugate group compared to the unconjugated oligonucleotide. There was a further increase in the duration of action for the conjugated mixed PO/PS oligonucleotide 647536 as compared to the conjugated full PS oligonucleotide 647535.

Example 58

Dose-Dependent Study of Oligonucleotides Comprising a 3'-Conjugate Group (Comparison of GalNAc$_3$-1 and GalNAc$_4$-11) Targeting SRB-1 In Vivo The oligonucleotides listed below were tested in a dose-dependent study for antisense inhibition of SRB-1 in mice. Unconjugated ISIS 440762 was included as an unconjugated standard. Each of the conjugate groups were attached at the 3' terminus of the respective oligonucleotide by a phosphodiester linked 2'-deoxyadenosine nucleoside cleavable moiety. The structure of GalNAc$_3$-1$_a$ was shown previously in Example 9. The structure of GalNAc$_3$-11$_a$ was shown previously in Example 50.

Treatment

Six week old male Balb/c mice (Jackson Laboratory, Bar Harbor, Me.) were injected subcutaneously once at the dosage shown below with ISIS 440762, 651900, 663748 or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

Example 57

Duration of Action Study of Oligonucleotides Comprising a 3'-Conjugate Group Targeting ApoC III In Vivo Mice were injected once with the doses indicated below and monitored over the course of 42 days for ApoC-III and plasma triglycerides (Plasma TG) levels. The study was performed using 3 transgenic mice that express human APOC-III in each group.

TABLE 45

Modified ASO targeting ApoC III

| ASO | Sequence (5' to 3') | Linkages | SEQ ID No. |
|---|---|---|---|
| ISIS 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | PS | 4878 |
| ISIS 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do}$-GalNAc$_3$-1$_a$ | PS | 4879 |
| ISIS 647536 | A$_{es}$G$_{eo}$$^m$C$_{eo}$T$_{eo}$T$_{eo}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{eo}$T$_{eo}$T$_{es}$A$_{es}$T$_{eo}$A$_{do}$-GalNAc$_3$-1$_a$ | PO/PS | 4879 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9.

As illustrated in Table 47, treatment with antisense oligonucleotides lowered SRB-1 mRNA levels in a dose-dependent manner. The antisense oligonucleotides comprising the phosphodiester linked GalNAc$_3$-1 and GalNAc$_4$-11 conjugates at the 3' terminus (ISIS 651900 and ISIS 663748) showed substantial improvement in potency compared to the unconjugated antisense oligonucleotide (ISIS 440762). The two conjugated oligonucleotides, GalNAc$_3$-1 and GalNAc$_4$-11, were equipotent.

TABLE 47

Modified ASO targeting SRB-1

| ASO | Sequence (5' to 3') | Dose mg/kg | % Saline control | SEQ ID No. |
|---|---|---|---|---|
| Saline | | | 100 | |
| ISIS 440762 | $T_{ks}{}^mC_{ks}A_{ds}G_{ds}T_{ds}{}^mC_{ds}A_{ds}$ $T_{ds}G_{ds}A_{ds}{}^mC_{ds}T_{ds}T_{ks}{}^mC_k$ | 0.6<br>2<br>6 | 73.45<br>59.66<br>23.50 | 4880 |
| ISIS 651900 | $T_{ks}{}^mC_{ks}A_{ds}G_{ds}T_{ds}{}^mC_{ds}A_{ds}$ $T_{ds}G_{ds}A_{ds}{}^mC_{ds}T_{ds}T_{ks}{}^mC_{ko}$ $A_{do}$-GalNAc$_3$-1$_a$ | 0.2<br>0.6<br>2<br>6 | 62.75<br>29.14<br>8.61<br>5.62 | 4881 |
| ISIS 663748 | $T_{ks}{}^mC_{ks}A_{ds}G_{ds}T_{ds}{}^mC_{ds}A_{ds}$ $T_{ds}G_{ds}A_{ds}{}^mC_{ds}T_{ds}T_{ks}{}^mC_{ko}$ $A_{do}$-GalNAc$_4$-11$_a$ | 0.2<br>0.6<br>2<br>6 | 63.99<br>33.53<br>7.58<br>5.52 | 4881 |

Capital letters indicate the nucleobase for each nucleoside and $^mC$ indicates a 5-methyl cytosine. Subscripts: "e" indicates a 2'-MOE modified nucleoside; "k" indicates 6'-(S)—CH$_3$ bicyclic nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group. ALTs, ASTs, total bilirubin and BUN values are shown in Table 48 below.

TABLE 48

| ISIS No. | Dosage mg/kg | ALT | AST | Total Bilirubin | BUN | Conjugate |
|---|---|---|---|---|---|---|
| Saline | | 30 | 76 | 0.2 | 40 | |
| 440762 | 0.60 | 32 | 70 | 0.1 | 35 | none |
| | 2 | 26 | 57 | 0.1 | 35 | |
| | 6 | 31 | 48 | 0.1 | 39 | |
| 651900 | 0.2 | 32 | 115 | 0.2 | 39 | GalNac$_3$-1 (3') |
| | 0.6 | 33 | 61 | 0.1 | 35 | |
| | 2 | 30 | 50 | 0.1 | 37 | |
| | 6 | 34 | 52 | 0.1 | 36 | |
| 663748 | 0.2 | 28 | 56 | 0.2 | 36 | GalNac$_4$-11 (3') |
| | 0.6 | 34 | 60 | 0.1 | 35 | |
| | 2 | 44 | 62 | 0.1 | 36 | |
| | 6 | 38 | 71 | 0.1 | 33 | |

Example 59

Effects of GalNAc$_3$-1 Conjugated ASOs Targeting FXI In Vivo

The oligonucleotides listed below were tested in a multiple dose study for antisense inhibition of FXI in mice. ISIS 404071 was included as an unconjugated standard. Each of the conjugate groups was attached at the 3' terminus of the respective oligonucleotide by a phosphodiester linked 2'-deoxyadenosine nucleoside cleavable moiety.

TABLE 49

Modified ASOs targeting FXI

| ASO | Sequence (5' to 3') | Linkages | SEQ ID No. |
|---|---|---|---|
| ISIS 404071 | $T_{es}G_{es}G_{es}T_{es}A_{es}A_{ds}T_{ds}{}^mC_{ds}{}^mC_{ds}A_{ds}{}^m$ $C_{ds}T_{ds}T_{ds}T_{ds}{}^mC_{ds}A_{es}G_{es}A_{es}G_{es}G_e$ | PS | 4889 |
| ISIS 656172 | $T_{es}G_{es}G_{es}T_{es}A_{es}A_{ds}T_{ds}{}^mC_{ds}{}^mC_{ds}A_{ds}{}^m$ $C_{ds}T_{ds}T_{ds}T_{ds}{}^mC_{ds}A_{es}G_{es}A_{es}G_{es}G_{eo}$ $A_{do}$-GalNAc$_3$-1$_a$ | PS | 4890 |
| ISIS 656173 | $T_{es}G_{eo}G_{eo}T_{eo}A_{eo}A_{ds}T_{ds}{}^mC_{ds}{}^mC_{ds}A_{ds}{}^m$ $C_{ds}T_{ds}T_{ds}T_{ds}{}^mC_{ds}A_{eo}G_{eo}A_{es}G_{es}G_{eo}$ $A_{do}$-GalNAc$_3$-1$_a$ | PO/PS | 4890 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9.

Treatment

Six week old male Balb/c mice (Jackson Laboratory, Bar Harbor, Me.) were injected subcutaneously twice a week for 3 weeks at the dosage shown below with ISIS 404071, 656172, 656173 or with PBS treated control. Each treatment group consisted of 4 animals. The mice were sacrificed 72 hours following the final administration to determine the liver FXI mRNA levels using real-time PCR and RIBOGREEN® RNA quantification reagent (Molecular Probes, Inc. Eugene, Oreg.) according to standard protocols. Plasma FXI protein levels were also measured using ELISA. FXI mRNA levels were determined relative to total RNA (using RIBOGREEN®), prior to normalization to PBS-treated control. The results below are presented as the average percent of FXI mRNA levels for each treatment group. The data was normalized to PBS-treated control and is denoted as "% PBS". The ED$_{50}$s were measured using similar methods as described previously and are presented below.

TABLE 50

Factor XI mRNA (% Saline)

| ASO | Dose mg/kg | % Control | Conjugate | Linkages |
|---|---|---|---|---|
| Saline | | 100 | none | |
| ISIS 404071 | 3<br>10<br>30 | 92<br>40<br>15 | none | PS |
| ISIS 656172 | 0.7<br>2<br>6 | 74<br>33<br>9 | GalNAc$_3$-1 | PS |
| ISIS 656173 | 0.7<br>2<br>6 | 49<br>22<br>1 | GalNAc$_3$-1 | PO/PS |

As illustrated in Table 50, treatment with antisense oligonucleotides lowered FXI mRNA levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

As illustrated in Table 50a, treatment with antisense oligonucleotides lowered FXI protein levels in a dose-dependent manner. The oligonucleotides comprising a 3'-GalNAc$_3$-1 conjugate group showed substantial improvement in potency compared to the unconjugated antisense oligonucleotide (ISIS 404071). Between the two conjugated oligonucleotides an improvement in potency was further provided by substituting some of the PS linkages with PO (ISIS 656173).

TABLE 50a

Factor XI protein (% Saline)

| ASO | Dose mg/kg | Protein (% Control) | Conjugate | Linkages |
|---|---|---|---|---|
| Saline | | 100 | none | |
| ISIS 404071 | 3 | 127 | none | PS |
| | 10 | 32 | | |
| | 30 | 3 | | |
| ISIS 656172 | 0.7 | 70 | GalNAc$_3$-1 | PS |
| | 2 | 23 | | |
| | 6 | 1 | | |
| ISIS 656173 | 0.7 | 45 | GalNAc$_3$-1 | PO/PS |
| | 2 | 6 | | |
| | 6 | 0 | | |

Liver transaminase levels, alanine aminotransferase (ALT) and aspartate aminotransferase (AST), in serum were measured relative to saline injected mice using standard protocols. Total bilirubin, total albumin, CRE and BUN were also evaluated. The change in body weights was evaluated with no significant change from the saline group. ALTs, ASTs, total bilirubin and BUN values are shown in the table below.

TABLE 51

| ISIS No. | Dosage mg/kg | ALT | AST | Total Albumin | Total Bilirubin | CRE | BUN | Conjugate |
|---|---|---|---|---|---|---|---|---|
| Saline | | 71.8 | 84.0 | 3.1 | 0.2 | 0.2 | 22.9 | |
| 404071 | 3 | 152.8 | 176.0 | 3.1 | 0.3 | 0.2 | 23.0 | none |
| | 10 | 73.3 | 121.5 | 3.0 | 0.2 | 0.2 | 21.4 | |
| | 30 | 82.5 | 92.3 | 3.0 | 0.2 | 0.2 | 23.0 | |
| 656172 | 0.7 | 62.5 | 111.5 | 3.1 | 0.2 | 0.2 | 23.8 | GalNac$_3$-1 (3') |
| | 2 | 33.0 | 51.8 | 2.9 | 0.2 | 0.2 | 22.0 | |
| | 6 | 65.0 | 71.5 | 3.2 | 0.2 | 0.2 | 23.9 | |
| 656173 | 0.7 | 54.8 | 90.5 | 3.0 | 0.2 | 0.2 | 24.9 | GalNac$_3$-1 (3') |
| | 2 | 85.8 | 71.5 | 3.2 | 0.2 | 0.2 | 21.0 | |
| | 6 | 114.0 | 101.8 | 3.3 | 0.2 | 0.2 | 22.7 | |

Example 60

Effects of Conjugated ASOs Targeting SRB-1 In Vitro

The oligonucleotides listed below were tested in a multiple dose study for antisense inhibition of SRB-1 in primary mouse hepatocytes. ISIS 353382 was included as an unconjugated standard. Each of the conjugate groups were attached at the 3' or 5' terminus of the respective oligonucleotide by a phosphodiester linked 2'-deoxyadenosine nucleoside cleavable moiety.

TABLE 52

Modified ASO targeting SRB-1

| ASO | Sequence (5' to 3') | Motif | Conjugate | SEQ ID No. |
|---|---|---|---|---|
| ISIS 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | none | 4886 |
| ISIS 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$-GalNAc$_3$-1$_a$ | 5/10/5 | GalNAc$_3$-1 | 4887 |
| ISIS 655862 | G$_{eo}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_{eo}$A$_{do}$-GalNAc$_3$-1$_a$ | 5/10/5 | GalNAc$_3$-1 | 4887 |
| ISIS 661161 | GalNAc$_3$-3$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-3 | 4888 |
| ISIS 665001 | GalNAc$_3$-8$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-8 | 4888 |
| ISIS 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$-GalNAc$_3$-9$_a$ | 5/10/5 | GalNAc$_3$-9 | 4887 |
| ISIS 666961 | GalNAc$_3$-6$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-6 | 4888 |
| ISIS 664507 | GalNAc$_3$-2$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-2 | 4888 |
| ISIS 666881 | GalNA$_3$-10$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-10 | 4888 |
| ISIS 666224 | GalNAc$_3$-5$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-5 | 4888 |
| ISIS 666981 | GalNAc$_3$-7$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 5/10/5 | GalNAc$_3$-7 | 4888 |

Capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-1$_a$ was shown previously in Example 9. The structure of GalNAc$_3$-3a was shown previously in Example 39. The structure of GalNAc$_3$-8a was shown previously in Example 47. The structure of GalNAc$_3$-9a was shown previously in Example 52. The structure of GalNAc$_3$-6a was shown previously in Example 51. The structure of GalNAc$_3$-2a was shown previously in Example 37. The structure of GalNAc$_3$-10a was shown previously in Example 46. The structure of GalNAc$_3$-5a was shown previously in Example 49. The structure of GalNAc$_3$-7a was shown previously in Example 48.

Treatment

The oligonucleotides listed above were tested in vitro in primary mouse hepatocyte cells plated at a density of 25,000 cells per well and treated with 0.03, 0.08, 0.24, 0.74, 2.22, 6.67 or 20 nM modified oligonucleotide. After a treatment period of approximately 16 hours, RNA was isolated from the cells and mRNA levels were measured by quantitative real-time PCR and the SRB-1 mRNA levels were adjusted according to total RNA content, as measured by RIBOGREEN®.

The IC$_{50}$ was calculated using standard methods and the results are presented in Table 53. The results show that, under free uptake conditions in which no reagents or electroporation techniques are used to artificially promote entry of the oligonucleotides into cells, the oligonucleotides comprising a GalNAc conjugate were significantly more potent in hepatocytes than the parent oligonucleotide (ISIS 353382) that does not comprise a GalNAc conjugate.

TABLE 53

| ASO | IC$_{50}$ (nM) | Internucleoside linkages | Conjugate | SEQ ID No. |
| --- | --- | --- | --- | --- |
| ISIS 353382 | 190[a] | PS | none | 4886 |
| ISIS 655861 | 11[a] | PS | GalNAc$_3$-1 | 4887 |
| ISIS 655862 | 3 | PO/PS | GalNAc$_3$-1 | 4887 |
| ISIS 661161 | 15[a] | PS | GalNAc$_3$-3 | 4888 |
| ISIS 665001 | 20 | PS | GalNAc$_3$-8 | 4888 |
| ISIS 664078 | 55 | PS | GalNAc$_3$-9 | 4887 |
| ISIS 666961 | 22[a] | PS | GalNAc$_3$-6 | 4888 |
| ISIS 664507 | 30 | PS | GalNAc$_3$-2 | 4888 |
| ISIS 666881 | 30 | PS | GalNAc$_3$-10 | 4888 |
| ISIS 666224 | 30[a] | PS | GalNAc$_3$-5 | 4888 |
| ISIS 666981 | 40 | PS | GalNAc$_3$-7 | 4888 |

Example 61

Preparation of Oligomeric Compound 175 Comprising GalNAc$_3$-12

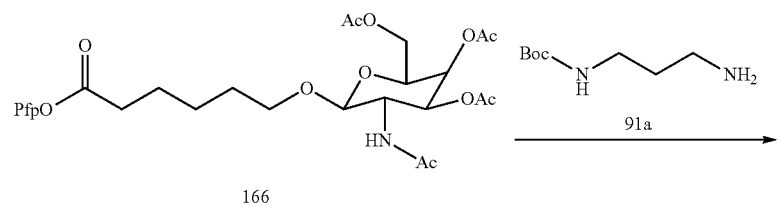

166

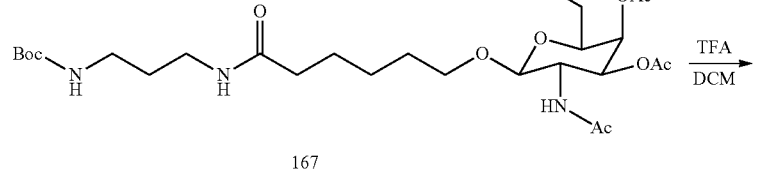

167

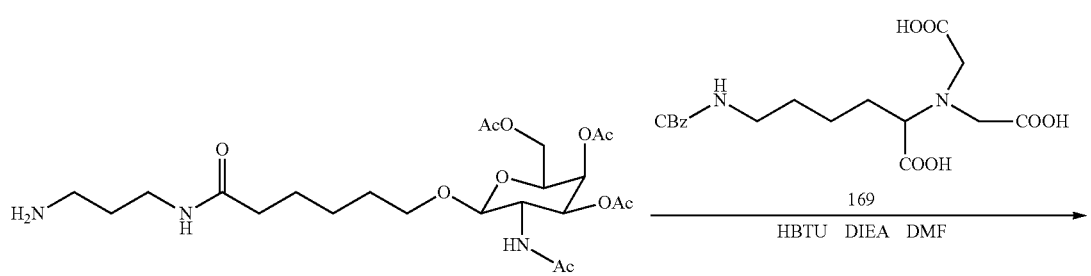

168

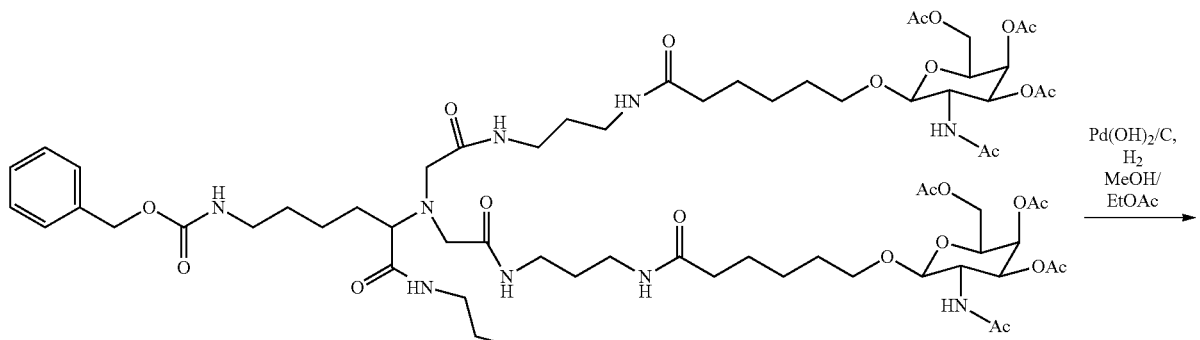
170
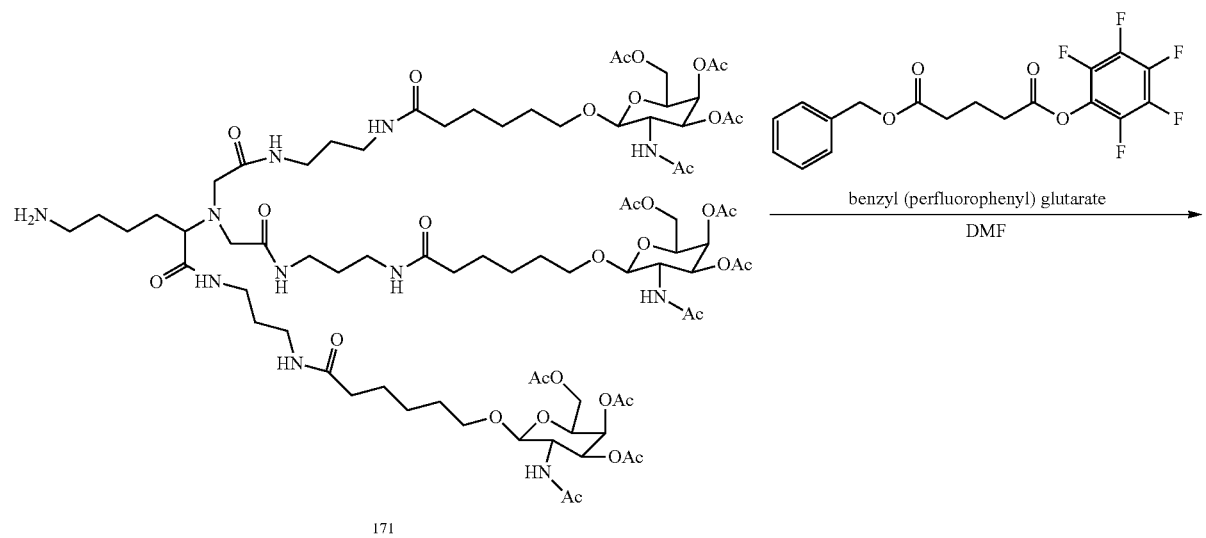
171
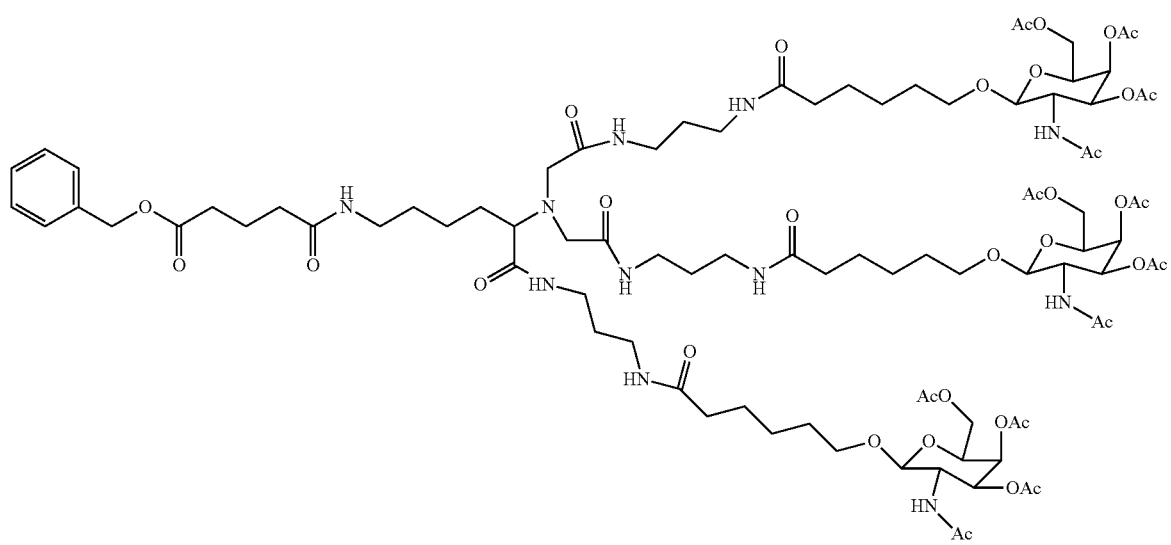
172

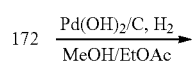
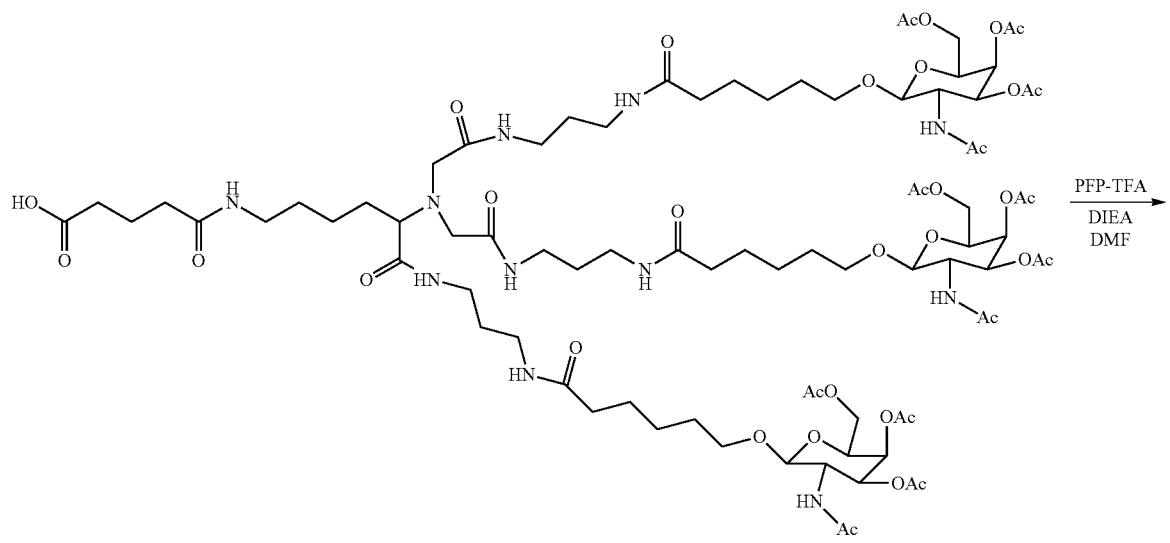
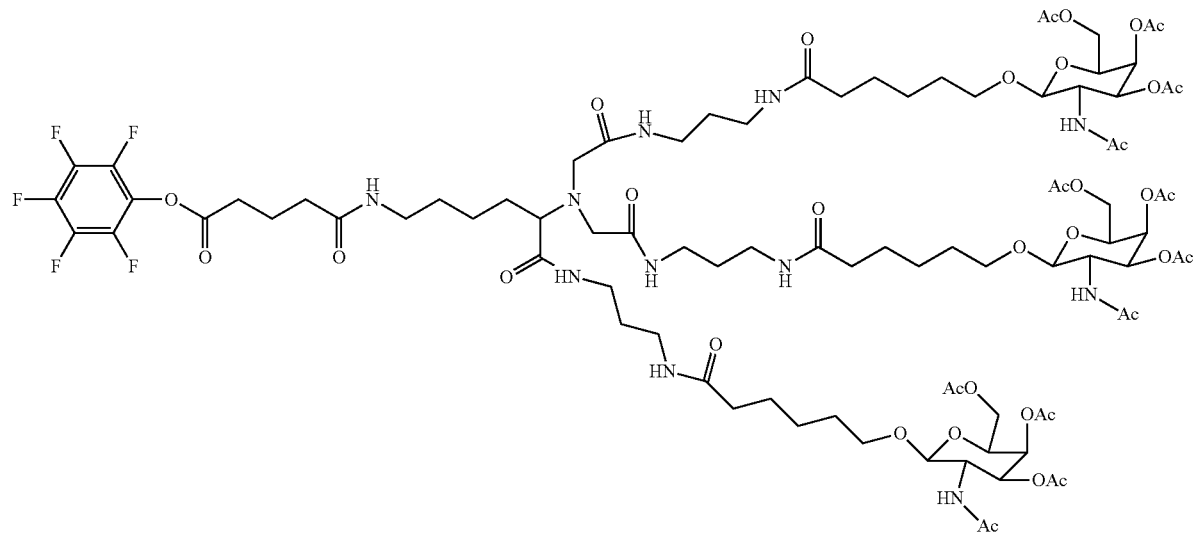
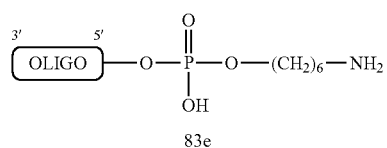
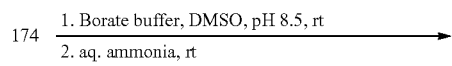

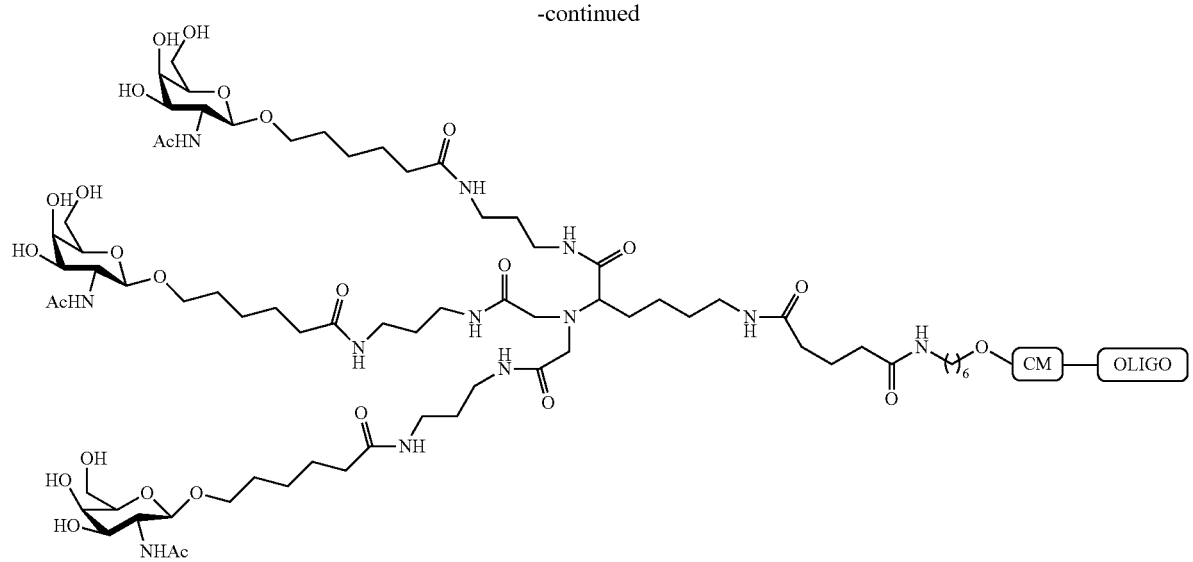

175

Compound 169 is commercially available. Compound 172 was prepared by addition of benzyl (perfluorophenyl) glutarate to compound 171. The benzyl (perfluorophenyl) glutarate was prepared by adding PFP-TFA and DIEA to 5-(benzyloxy)-5-oxopentanoic acid in DMF. Oligomeric compound 175, comprising a GalNAc$_3$-12 conjugate group, was prepared from compound 174 using the general procedures illustrated in Example 46. The GalNAc$_3$ cluster portion of the conjugate group GalNAc$_3$-12 (GalNAc$_3$-12$_a$) can be combined with any cleavable moiety to provide a variety of conjugate groups. In a certain embodiments, the cleavable moiety is —P(=O)(OH)-A$_d$-P(=O)(OH)—. The structure of GalNAc$_3$-12 (GalNAc$_3$-12$_a$-CM-) is shown below:

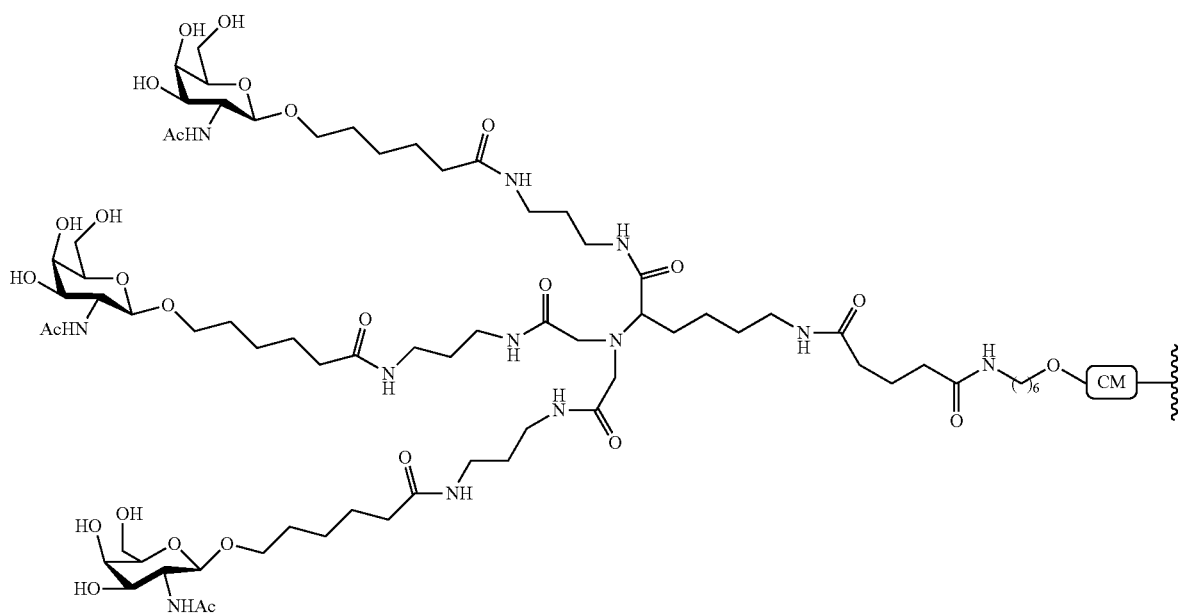

Example 62
Preparation of Oligomeric Compound 180 Comprising GalNAc$_3$-13
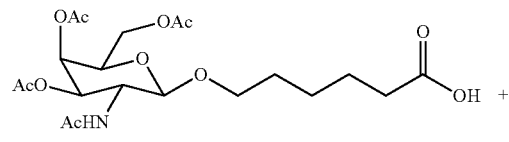
176
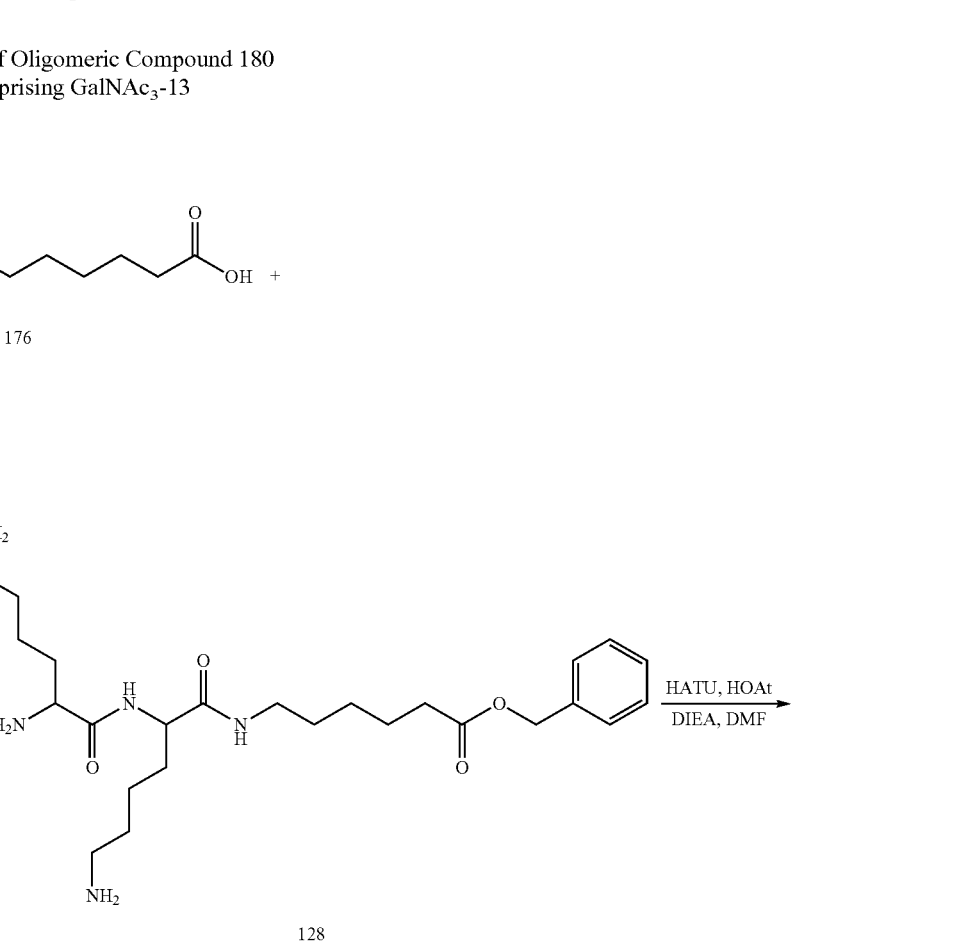
128
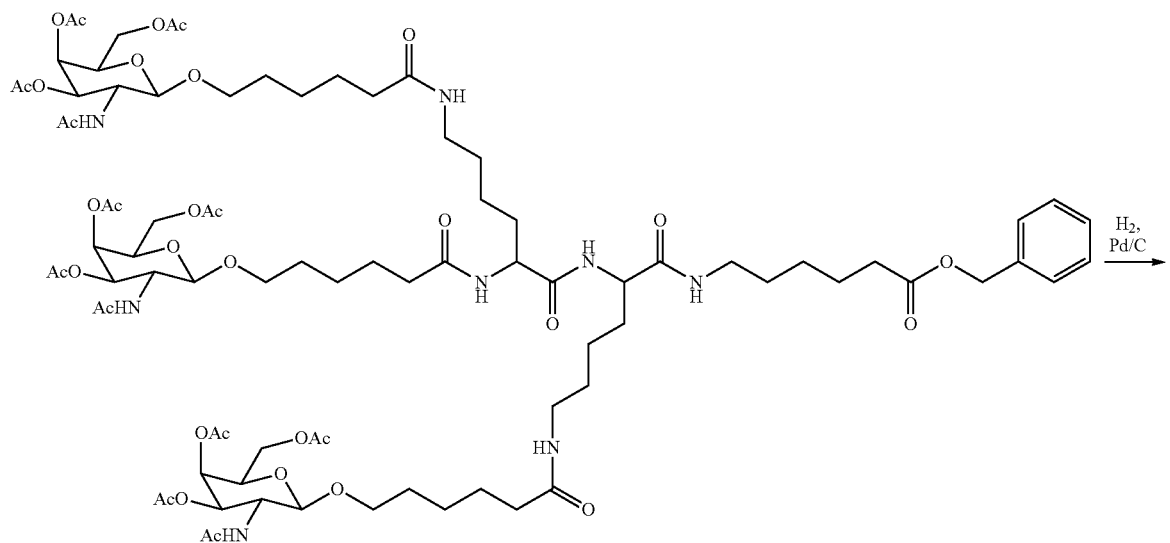
177

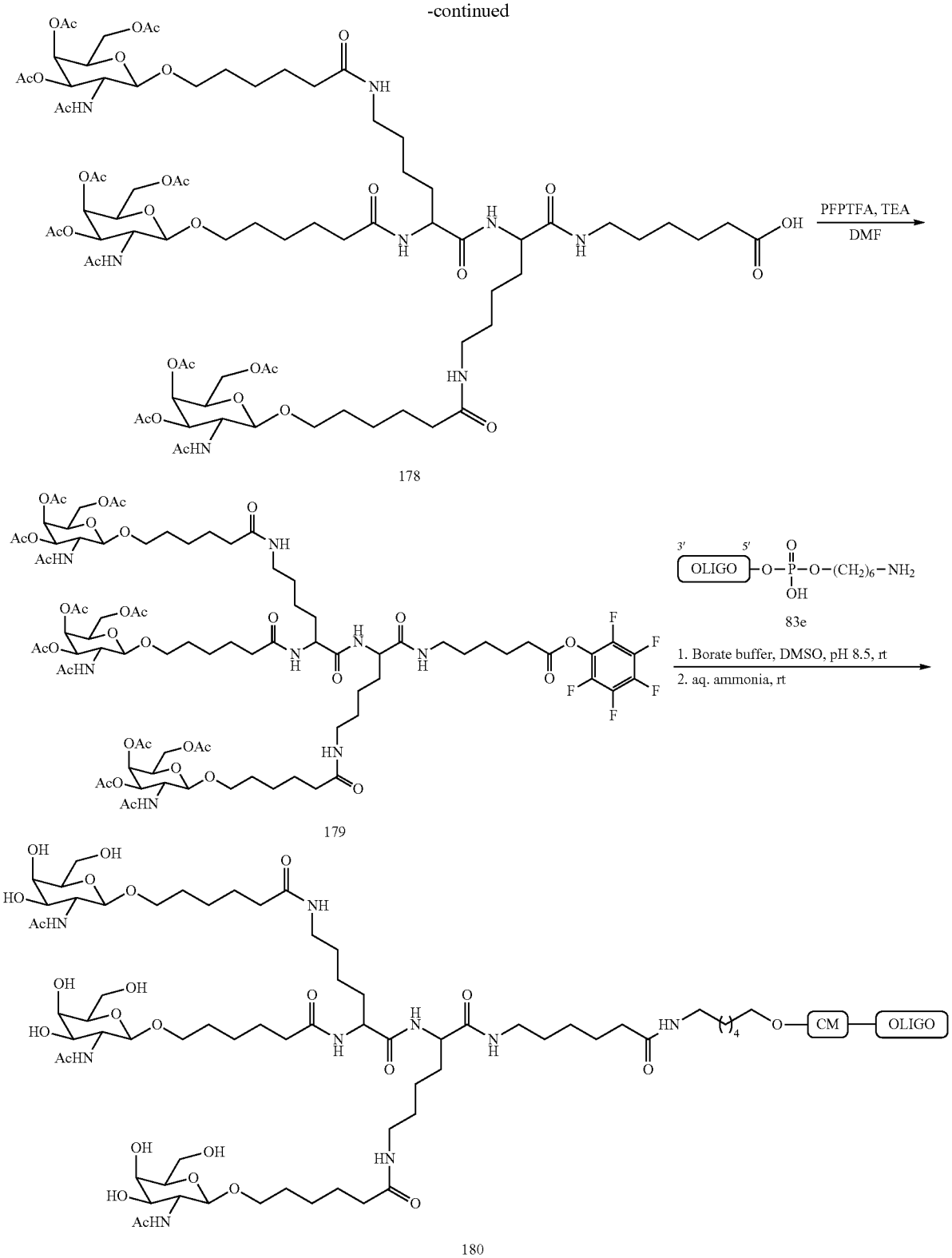

Compound 176 was prepared using the general procedure shown in Example 2. Oligomeric compound 180, comprising a GalNAc$_3$-13 conjugate group, was prepared from compound 177 using the general procedures illustrated in Example 49. The GalNAc$_3$ cluster portion of the conjugate group GalNAc$_3$-13 (GalNAc$_3$-13$_a$) can be combined with any cleavable moiety to provide a variety of conjugate groups. In a certain embodiments, the cleavable moiety is —P(=O)(OH)-A$_d$-P(=O)(OH)—. The structure of GalNAc$_3$-13 (GalNAc$_3$-13$_a$-CM-) is shown below:

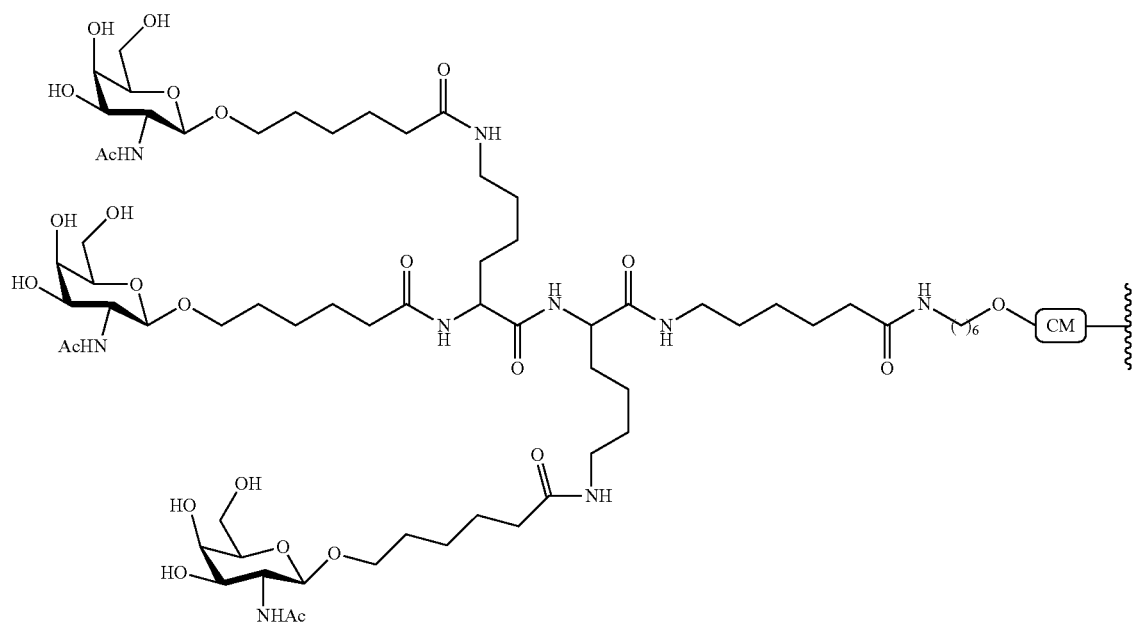
Example 63
Preparation of Oligomeric Compound 188 Comprising GalNAc$_3$-14
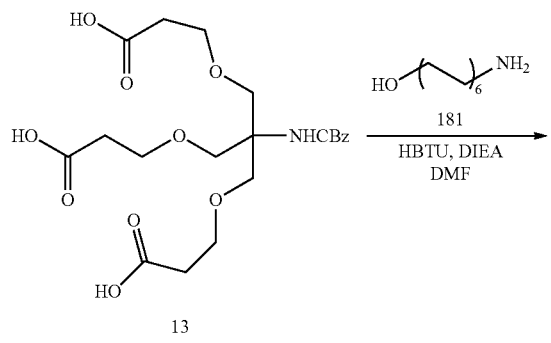
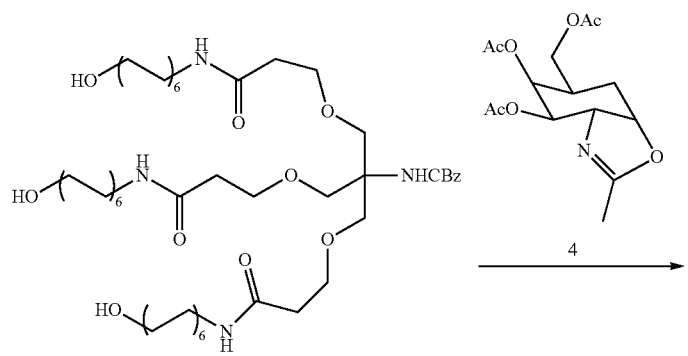

-continued
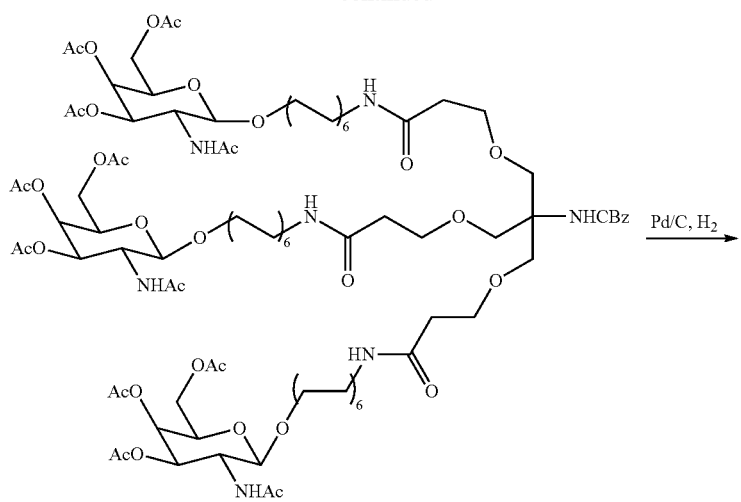
183
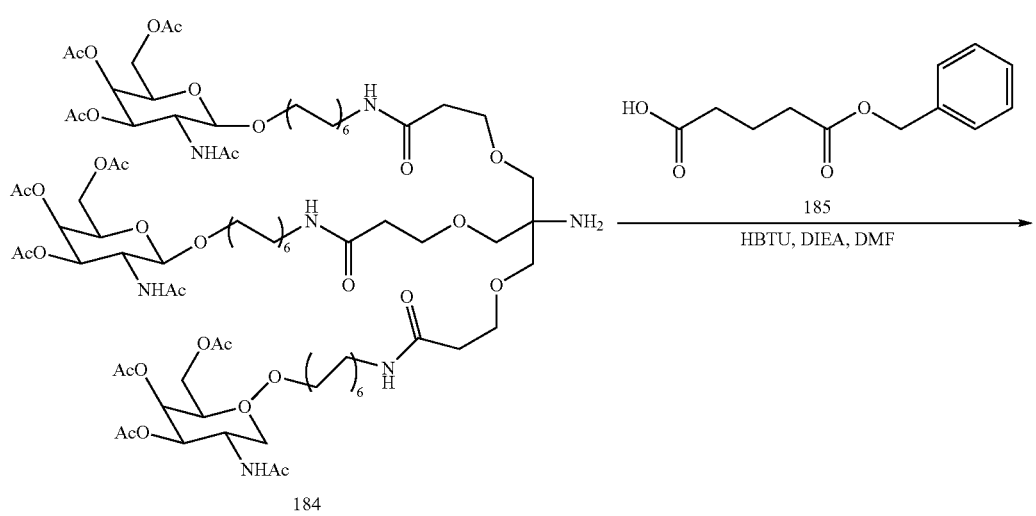
184
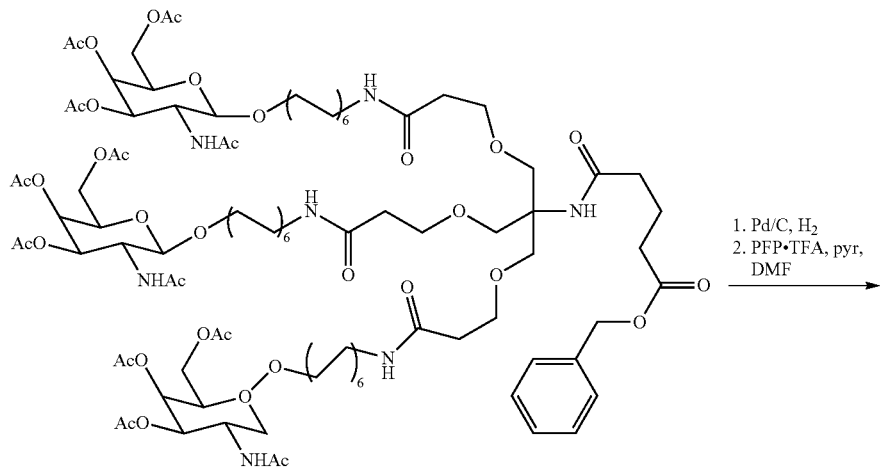
186

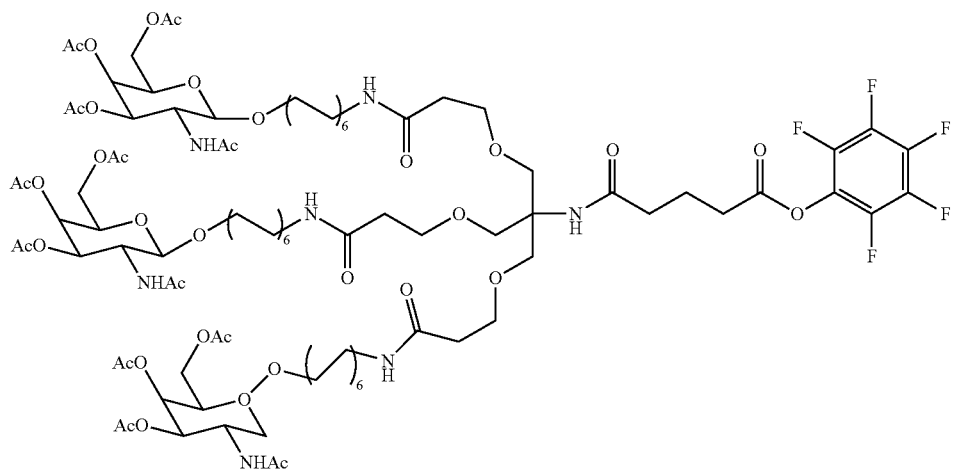

187

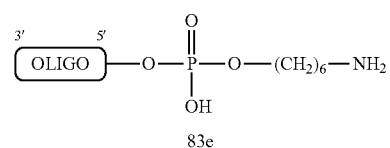

83e

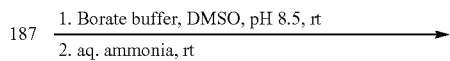

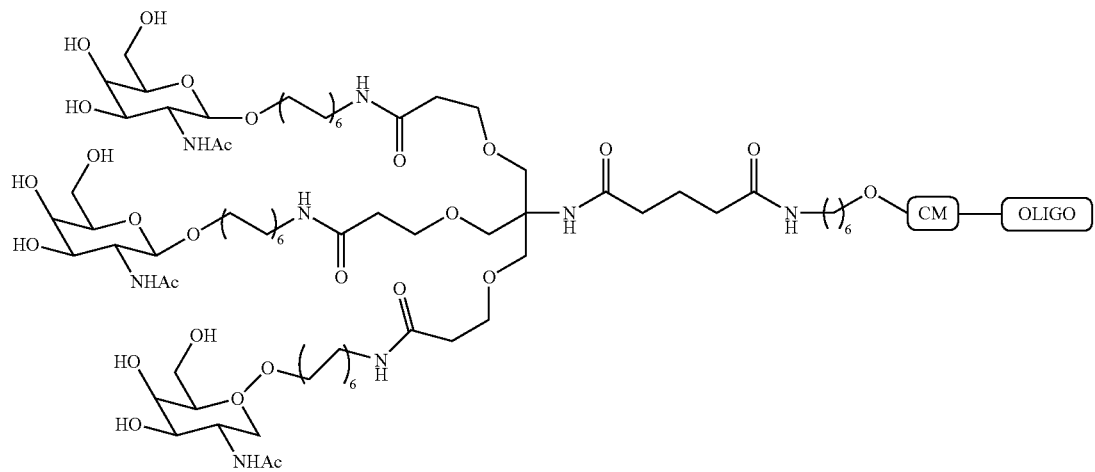

188

Compounds 181 and 185 are commercially available. Oligomeric compound 188, comprising a GalNAc$_3$-14 conjugate group, was prepared from compound 187 using the general procedures illustrated in Example 46. The GalNAc$_3$ cluster portion of the conjugate group GalNAc$_3$-14 (GalNAc$_3$-14$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-14 (GalNAc$_3$-14$_a$-CM-) is shown below:

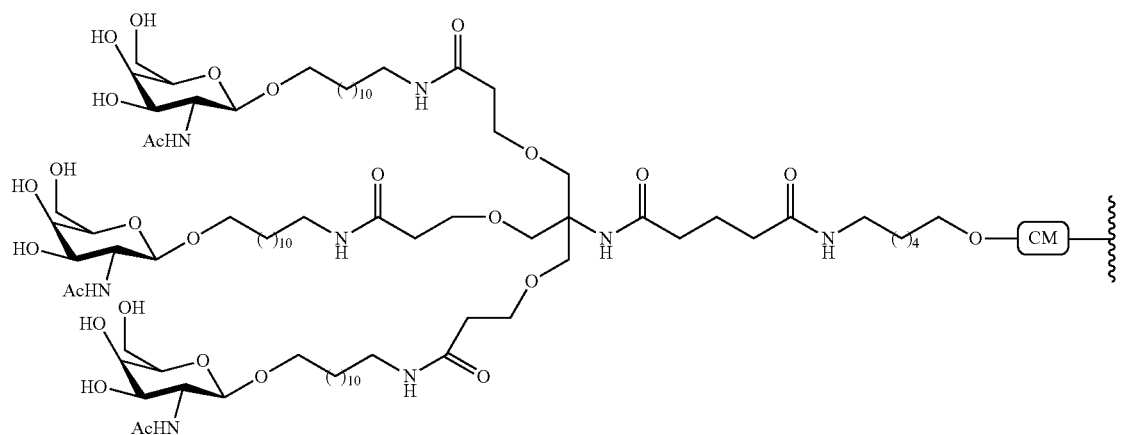
Example 64
Preparation of Oligomeric Compound 197
Comprising GalNAc₃-15
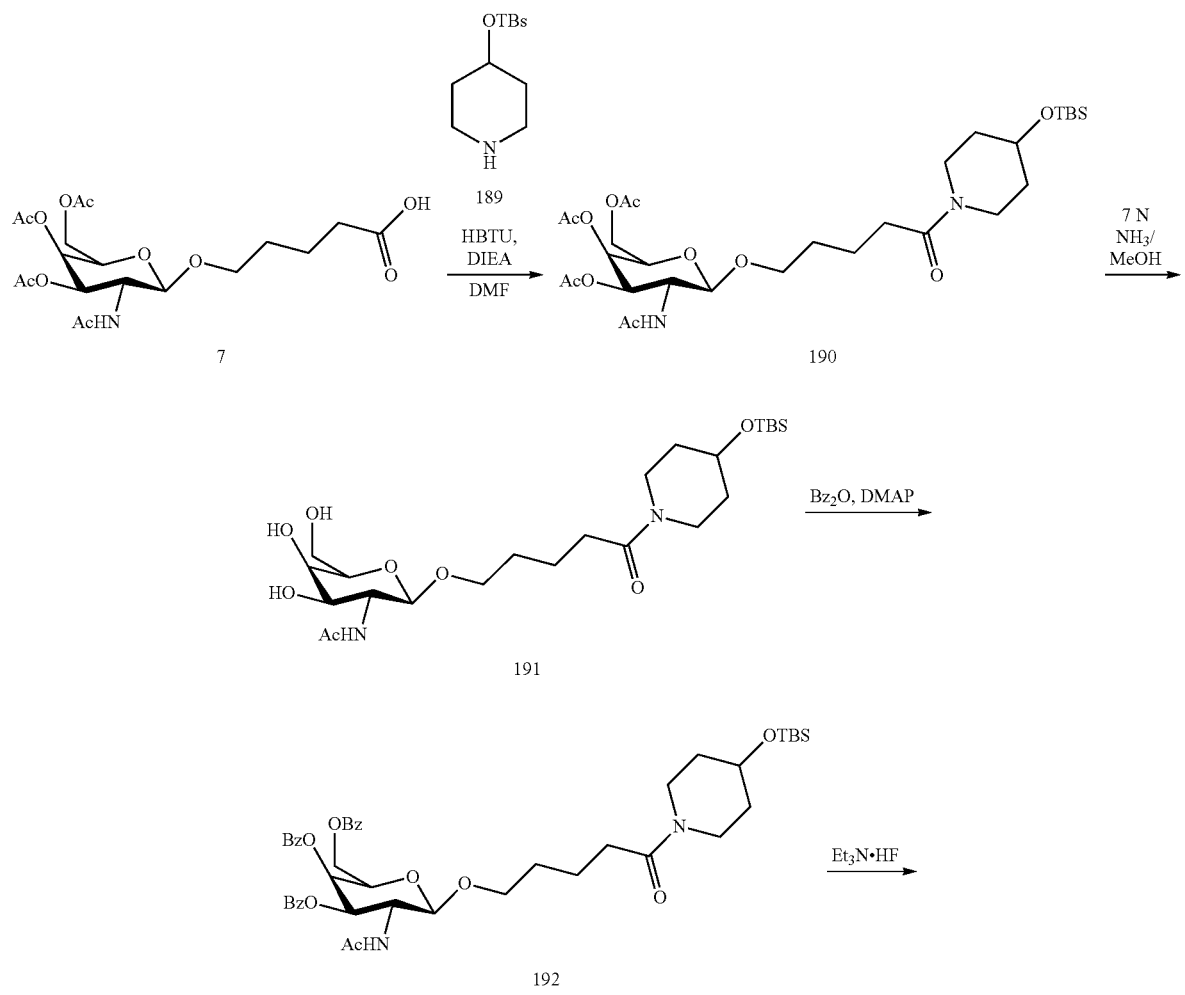

-continued
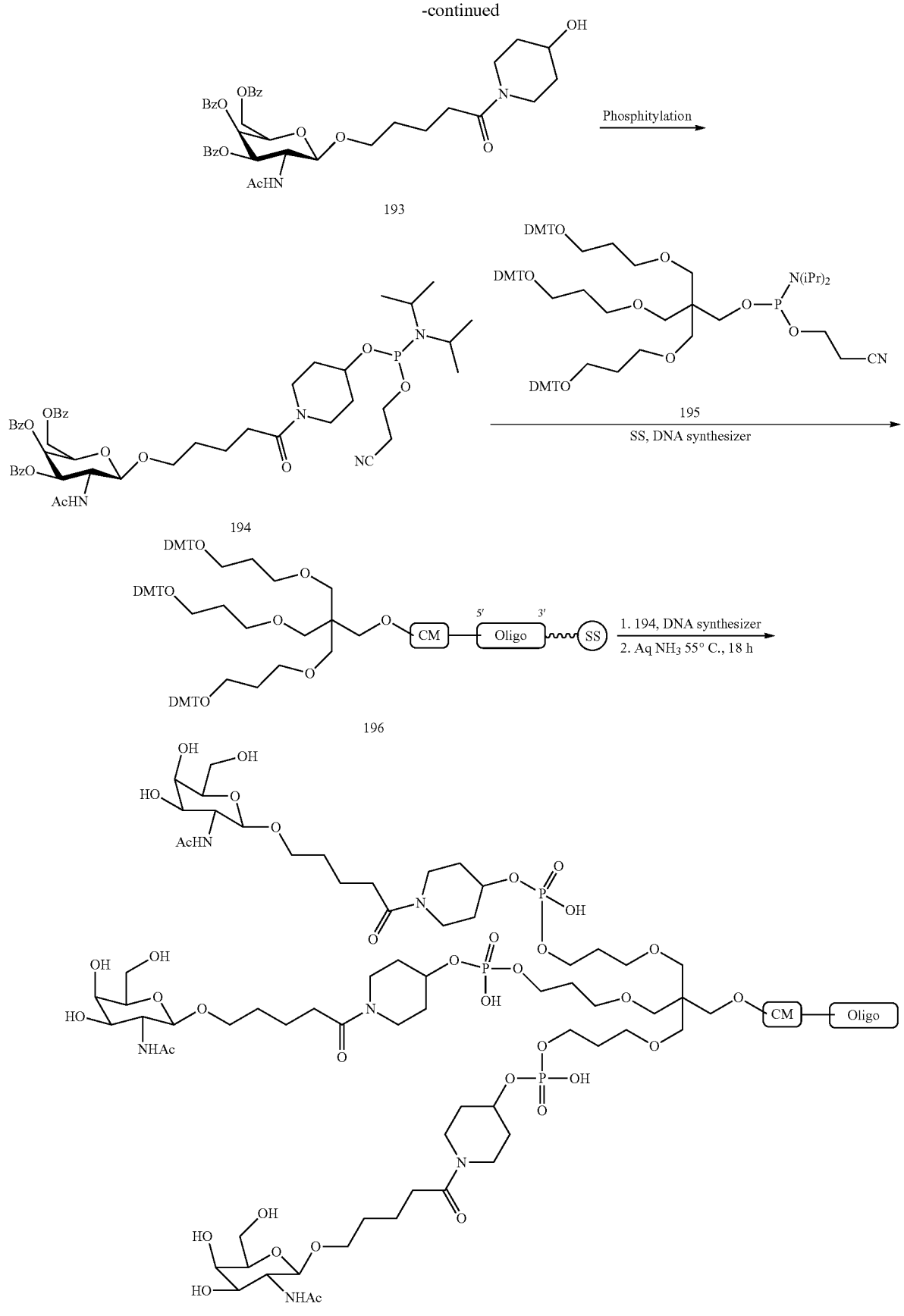

Compound 189 is commercially available. Compound 195 was prepared using the general procedure shown in Example 31. Oligomeric compound 197, comprising a GalNAc$_3$-15 conjugate group, was prepared from compounds 194 and 195 using standard oligonucleotide synthesis procedures. The GalNAc$_3$ cluster portion of the conjugate group GalNAc$_3$-15 (GalNAc$_3$-15$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-15 (GalNAc$_3$-15$_a$-CM-) is shown below:

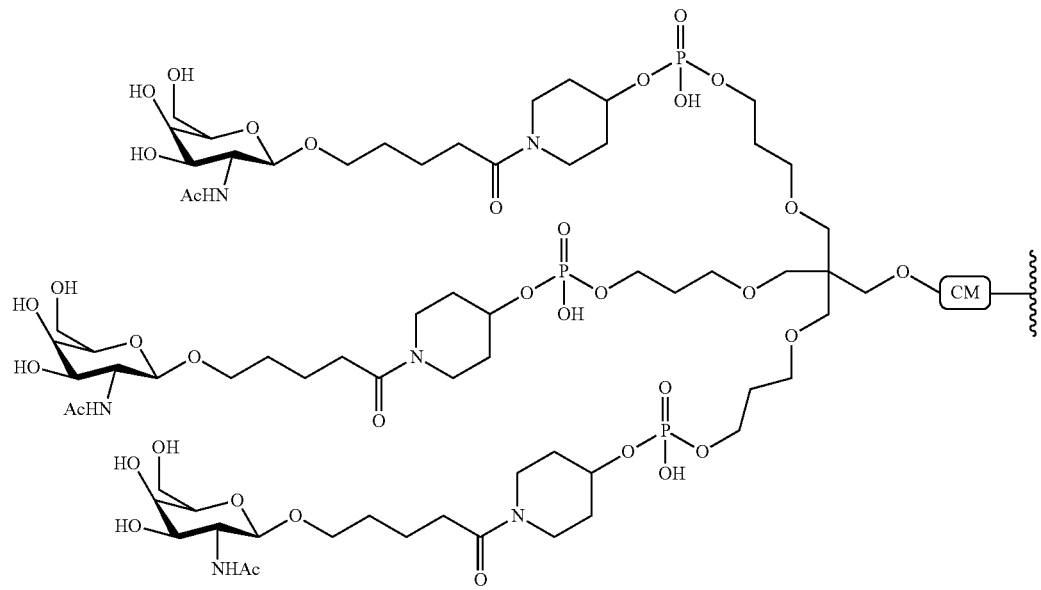

Example 65

Dose-Dependent Study of Oligonucleotides Comprising a 5'-Conjugate Group (Comparison of GalNAc$_3$-3, 12, 13, 14, and 15) Targeting SRB-1 In Vivo The oligonucleotides listed below were tested in a dose-dependent study for antisense inhibition of SRB-1 in mice. Unconjugated ISIS 353382 was included as a standard. Each of the GalNAc$_3$ conjugate groups was attached at the 5' terminus of the respective oligonucleotide by a phosphodiester linked 2'-deoxyadenosine nucleoside (cleavable moiety).

TABLE 54

| | Modified ASO targeting SRB-1 | | |
|---|---|---|---|
| ISIS No. | Sequence (5' to 3') | Conjugate | SEQ ID No. |
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$G$_{ds}$A$_{ds}$$^m$C$_{ds}$T$_{ds}$T$_{es}$$^m$C$_{es}$$^m$C$_{es}$T$_{es}$T$_e$ | none | 4886 |
| 661161 | GalNAc$_3$-3$_{a\text{-}o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3 | 4888 |
| 671144 | GalNAc$_3$-12$_{a\text{-}o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-12 | 4888 |
| 670061 | GalNAc$_3$-13$_{a\text{-}o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-13 | 4888 |
| 671261 | GalNAc$_3$-14$_{a\text{-}o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-14 | 4888 |
| 671262 | GalNAc$_3$-15$_{a\text{-}o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-15 | 4888 |

Capital letters indicate the nucleobase for each nucleoside and $^m$C indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-3$_a$ was shown previously in Example 39. The structure of GalNAc$_3$-12a was shown previously in Example 61. The structure of GalNAc$_3$-13a was shown previously in Example 62. The structure of GalNAc$_3$-14a was shown previously in Example 63. The structure of GalNAc$_3$-15a was shown previously in Example 64.

Treatment

Six to eight week old C57bl6 mice (Jackson Laboratory, Bar Harbor, Me.) were injected subcutaneously once or twice at the dosage shown below with ISIS 353382, 661161, 671144, 670061, 671261, 671262, or with saline. Mice that were dosed twice received the second dose three days after the first dose. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 55, treatment with antisense oligonucleotides lowered SRB-1 mRNA levels in a dose-dependent manner No significant differences in target knockdown were observed between animals that received a single dose and animals that received two doses (see ISIS 353382 dosages 30 and 2×15 mg/kg; and ISIS 661161 dosages 5 and 2×2.5 mg/kg). The antisense oligonucleotides comprising the phosphodiester linked GalNAc$_3$-3, 12, 13, 14, and 15 conjugates showed substantial improvement in potency compared to the unconjugated antisense oligonucleotide (ISIS 335382).

TABLE 55

SRB-1 mRNA (% Saline)

| ISIS No. | Dosage (mg/kg) | SRB-1 mRNA (% Saline) | ED$_{50}$ (mg/kg) | Conjugate |
|---|---|---|---|---|
| Saline | n/a | 100.0 | n/a | n/a |
| 353382 | 3 | 85.0 | 22.4 | none |
|  | 10 | 69.2 |  |  |
|  | 30 | 34.2 |  |  |
|  | 2 × 15 | 36.0 |  |  |
| 661161 | 0.5 | 87.4 | 2.2 | GalNAc$_3$-3 |
|  | 1.5 | 59.0 |  |  |
|  | 5 | 25.6 |  |  |
|  | 2 × 2.5 | 27.5 |  |  |
| 671144 | 15 | 17.4 | 3.4 | GalNAc$_3$-12 |
|  | 0.5 | 101.2 |  |  |
|  | 1.5 | 76.1 |  |  |
|  | 5 | 32.0 |  |  |
|  | 15 | 17.6 |  |  |
| 670061 | 0.5 | 94.8 | 2.1 | GalNAc$_3$-13 |
|  | 1.5 | 57.8 |  |  |
|  | 5 | 20.7 |  |  |
|  | 15 | 13.3 |  |  |
| 671261 | 0.5 | 110.7 | 4.1 | GalNAc$_3$-14 |
|  | 1.5 | 81.9 |  |  |
|  | 5 | 39.8 |  |  |
|  | 15 | 14.1 |  |  |
| 671262 | 0.5 | 109.4 |  |  |
|  | 1.5 | 99.5 | 9.8 | GalNAc$_3$-15 |
|  | 5 | 69.2 |  |  |
|  | 15 | 36.1 |  |  |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 56

| ISIS No. | Dosage (mg/kg) | ALT (U/L) | AST (U/L) | Total Bilirubin (mg/dL) | BUN (mg/dL) | Conjugate |
|---|---|---|---|---|---|---|
| Saline | n/a | 28 | 60 | 0.1 | 39 | n/a |
| 353382 | 3 | 30 | 77 | 0.2 | 36 | none |
|  | 10 | 25 | 78 | 0.2 | 36 |  |
|  | 30 | 28 | 62 | 0.2 | 35 |  |
|  | 2 × 15 | 22 | 59 | 0.2 | 33 |  |
| 661161 | 0.5 | 39 | 72 | 0.2 | 34 | GalNAc$_3$-3 |
|  | 1.5 | 26 | 50 | 0.2 | 33 |  |
|  | 5 | 41 | 80 | 0.2 | 32 |  |
|  | 2 × 2.5 | 24 | 72 | 0.2 | 28 |  |
|  | 15 | 32 | 69 | 0.2 | 36 |  |
| 671144 | 0.5 | 25 | 39 | 0.2 | 34 | GalNAc$_3$-12 |
|  | 1.5 | 26 | 55 | 0.2 | 28 |  |
|  | 5 | 48 | 82 | 0.2 | 34 |  |
|  | 15 | 23 | 46 | 0.2 | 32 |  |
| 670061 | 0.5 | 27 | 53 | 0.2 | 33 | GalNAc$_3$-13 |
|  | 1.5 | 24 | 45 | 0.2 | 35 |  |
|  | 5 | 23 | 58 | 0.1 | 34 |  |
|  | 15 | 24 | 72 | 0.1 | 31 |  |
| 671261 | 0.5 | 69 | 99 | 0.1 | 33 | GalNAc$_3$-14 |
|  | 1.5 | 34 | 62 | 0.1 | 33 |  |
|  | 5 | 43 | 73 | 0.1 | 32 |  |
|  | 15 | 32 | 53 | 0.2 | 30 |  |
| 671262 | 0.5 | 24 | 51 | 0.2 | 29 | GalNAc$_3$-15 |
|  | 1.5 | 32 | 62 | 0.1 | 31 |  |
|  | 5 | 30 | 76 | 0.2 | 32 |  |
|  | 15 | 31 | 64 | 0.1 | 32 |  |

Example 66

Effect of Various Cleavable Moieties on Antisense Inhibition In Vivo by Oligonucleotides Targeting SRB-1 Comprising a 5'-GalNAc$_3$ Cluster The oligonucleotides listed below were tested in a dose-dependent study for antisense inhibition of SRB-1 in mice. Each of the GalNAc$_3$ conjugate groups was attached at the 5' terminus of the respective oligonucleotide by a phosphodiester linked nucleoside (cleavable moiety (CM)).

TABLE 57

Modified ASOs targeting SRB-1

| ISIS No. | Sequences (5' to 3') | GalNAc$_3$ Cluster | CM | SEQ ID No. |
|---|---|---|---|---|
| 661161 | GalNAc$_3$-3$_{a\text{-}o'}$A$_{do}$G$_{es}$$^m$C$_{es}$ T$_{es}$T$_{es}$C$_{es}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{es}$$^m$C$_{es}$$^m$ C$_{es}$T$_{es}$T$_{e}$ | GalNAc$_3$-3a | A$_d$ | 4888 |
| 670699 | GalNAc$_3$-3$_{a\text{-}o'}$T$_{do}$G$_{es}$$^m$C$_{eo}$ T$_{eo}$T$_{eo}$$^m$C$_{eo}$A$_{ds}$G$_{ds}$T$_{ds}$$^m$C$_{ds}$ A$_{ds}$T$_{ds}$G$_{ds}$A$_{ds}$$^m$C$_{ds}$T$_{ds}$T$_{eo}$$^m$ C$_{eo}$$^m$C$_{es}$T$_{es}$T$_{e}$ | GalNAc$_3$-3a | T$_d$ | 4891 |
| 670700 | GalNAc$_3$-3$_{a\text{-}o'}$A$_{eo}$G$_{es}$$^m$C$_{eo}$ T$_{eo}$T$_{eo}$$^m$C$_{eo}$A$_{ds}$G$_{ds}$T$_{ds}$$^m$C$_{ds}$ A$_{ds}$T$_{ds}$G$_{ds}$A$_{ds}$$^m$C$_{ds}$T$_{ds}$T$_{eo}$$^m$ C$_{eo}$$^m$C$_{es}$T$_{es}$T$_{e}$ | GalNAc$_3$-3a | A$_d$ | 4888 |
| 670701 | GalNAc$_3$-3$_{a\text{-}o'}$T$_{eo}$G$_{es}$$^m$C$_{eo}$ T$_{eo}$T$_{eo}$$^m$C$_{eo}$A$_{ds}$G$_{ds}$T$_{ds}$$^m$C$_{ds}$ A$_{ds}$T$_{ds}$G$_{ds}$A$_{ds}$$^m$C$_{ds}$T$_{ds}$T$_{eo}$$^m$ C$_{eo}$$^m$C$_{es}$T$_{es}$T$_{e}$ | GalNAc$_3$-3a | T$_e$ | 4891 |
| 671165 | GalNAc$_3$-13$_{a\text{-}o'}$A$_{do}$G$_{es}$$^m$ C$_{eo}$T$_{eo}$T$_{eo}$$^m$C$_{eo}$A$_{ds}$G$_{ds}$T$_{ds}$$^m$ C$_{ds}$A$_{ds}$T$_{ds}$G$_{ds}$A$_{ds}$$^m$C$_{ds}$T$_{ds}$ T$_{eo}$$^m$C$_{eo}$$^m$C$_{es}$T$_{es}$T$_{e}$ | GalNAc$_3$-13a | A$_d$ | 4888 |

Capital letters indicate the nucleobase for each nucleoside and $^m$C indicates a 5-methyl cytosine. Subscripts: "e" indicates a 2'-MOE modified nucleoside; "d" indicates a β-D-2'- deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc$_3$-3$_a$ was shown previously in Example 39. The structure of GalNAc$_3$-13a was shown previously in Example 62.

Treatment

Six to eight week old C57bl6 mice (Jackson Laboratory, Bar Harbor, Me.) were injected subcutaneously once at the dosage shown below with ISIS 661161, 670699, 670700, 670701, 671165, or with saline. Each treatment group consisted of 4 animals. The mice were sacrificed 72 hours following the final administration to determine the liver SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 58, treatment with antisense oligonucleotides lowered SRB-1 mRNA levels in a dose-dependent manner. The antisense oligonucleotides comprising various cleavable moieties all showed similar potencies.

TABLE 58

| | | SRB-1 mRNA (% Saline) | | |
|---|---|---|---|---|
| ISIS No. | Dosage (mg/kg) | SRB-1 mRNA (% Saline) | GalNAc$_3$ Cluster | CM |
| Saline | n/a | 100.0 | n/a | n/a |
| 661161 | 0.5 | 87.8 | | |
| | 1.5 | 61.3 | | |
| | 5 | 33.8 | GalNAc$_3$-3a | A$_d$ |
| | 15 | 14.0 | | |
| 670699 | 0.5 | 89.4 | GalNAc$_3$-3a | T$_d$ |
| | 1.5 | 59.4 | | |
| | 5 | 31.3 | | |
| | 15 | 17.1 | | |
| 670700 | 0.5 | 79.0 | GalNAc$_3$-3a | A$_e$ |
| | 1.5 | 63.3 | | |
| | 5 | 32.8 | | |
| | 15 | 17.9 | | |
| 670701 | 0.5 | 79.1 | GalNAc$_3$-3a | T$_e$ |
| | 1.5 | 59.2 | | |
| | 5 | 35.8 | | |
| | 15 | 17.7 | | |
| 671165 | 0.5 | 76.4 | GalNAc$_3$-13a | A$_d$ |
| | 1.5 | 43.2 | | |

TABLE 58-continued

| | | SRB-1 mRNA (% Saline) | | |
|---|---|---|---|---|
| ISIS No. | Dosage (mg/kg) | SRB-1 mRNA (% Saline) | GalNAc$_3$ Cluster | CM |
| | 5 | 22.6 | | |
| | 15 | 10.0 | | |

Liver transaminase levels, alanine aminotransferase (ALT) and aspartate aminotransferase (AST), in serum were measured relative to saline injected mice using standard protocols. Total bilirubin and BUN were also evaluated. The changes in body weights were evaluated with no significant differences from the saline group (data not shown). ALTs, ASTs, total bilirubin and BUN values are shown in Table 56 below.

TABLE 59

| ISIS No. | Dosage (mg/kg) | ALT (U/L) | AST (U/L) | Total Bilirubin (mg/dL) | BUN (mg/dL) | GalNAc$_3$ Cluster | CM |
|---|---|---|---|---|---|---|---|
| Saline | n/a | 24 | 64 | 0.2 | 31 | n/a | n/a |
| 661161 | 0.5 | 25 | 64 | 0.2 | 31 | GalNAc$_3$-3a | A$_d$ |
| | 1.5 | 24 | 50 | 0.2 | 32 | | |
| | 5 | 26 | 55 | 0.2 | 28 | | |
| | 15 | 27 | 52 | 0.2 | 31 | | |
| 670699 | 0.5 | 42 | 83 | 0.2 | 31 | GalNAc$_3$-3a | T$_d$ |
| | 1.5 | 33 | 58 | 0.2 | 32 | | |
| | 5 | 26 | 70 | 0.2 | 29 | | |
| | 15 | 25 | 67 | 0.2 | 29 | | |
| 670700 | 0.5 | 40 | 74 | 0.2 | 27 | GalNAc$_3$-3a | A$_e$ |
| | 1.5 | 23 | 62 | 0.2 | 27 | | |
| | 5 | 24 | 49 | 0.2 | 29 | | |
| | 15 | 25 | 87 | 0.1 | 25 | | |
| 670701 | 0.5 | 30 | 77 | 0.2 | 27 | GalNAc$_3$-3a | T$_e$ |
| | 1.5 | 22 | 55 | 0.2 | 30 | | |
| | 5 | 81 | 101 | 0.2 | 25 | | |
| | 15 | 31 | 82 | 0.2 | 24 | | |
| 671165 | 0.5 | 44 | 84 | 0.2 | 26 | GalNAc$_3$-13a | A$_d$ |
| | 1.5 | 47 | 71 | 0.1 | 24 | | |
| | 5 | 33 | 91 | 0.2 | 26 | | |
| | 15 | 33 | 56 | 0.2 | 29 | | |

Example 67

Preparation of Oligomeric Compound 199 Comprising GalNAc$_3$-16

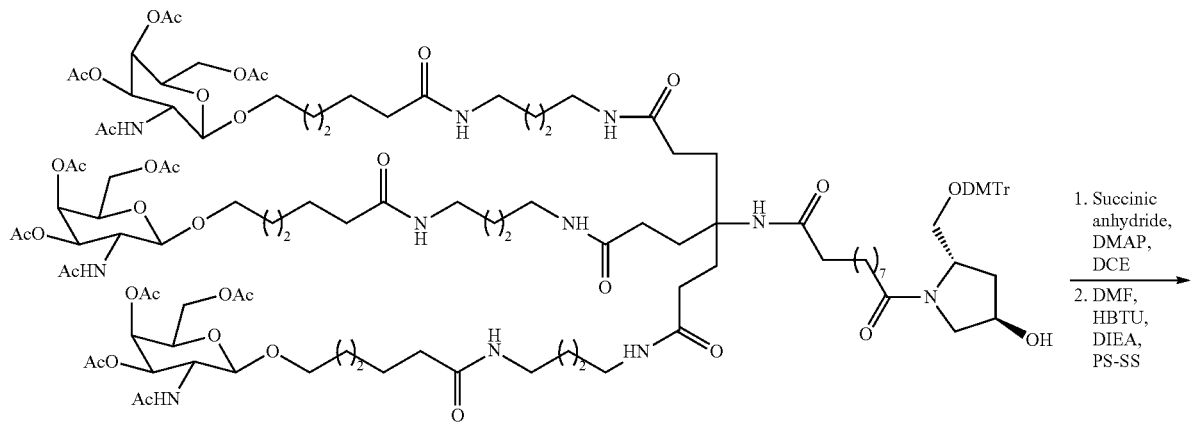

1. Succinic anhydride, DMAP, DCE
2. DMF, HBTU, DIEA, PS-SS

-continued

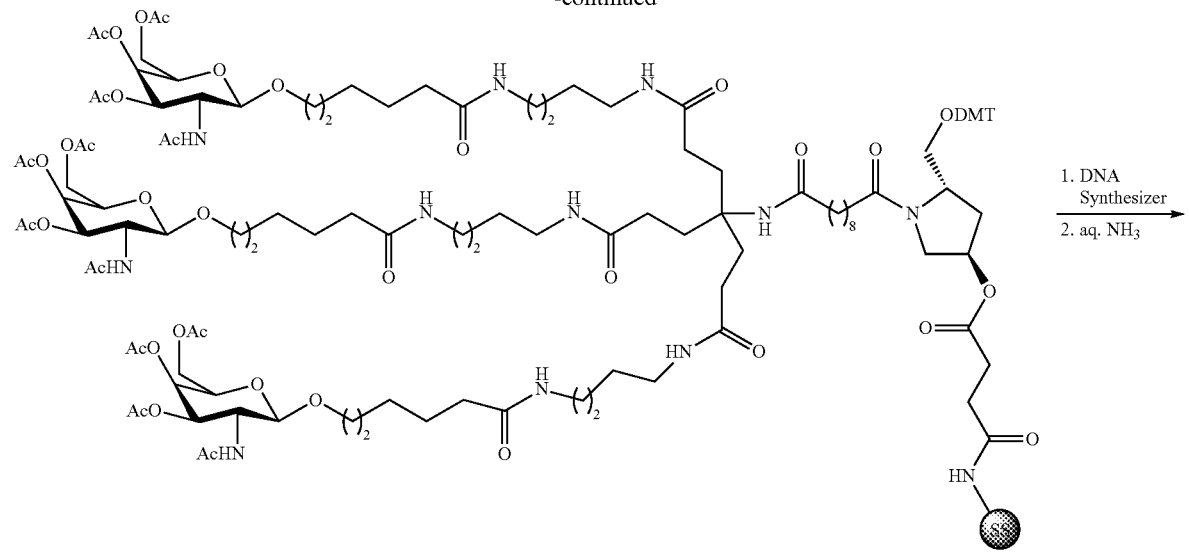

198

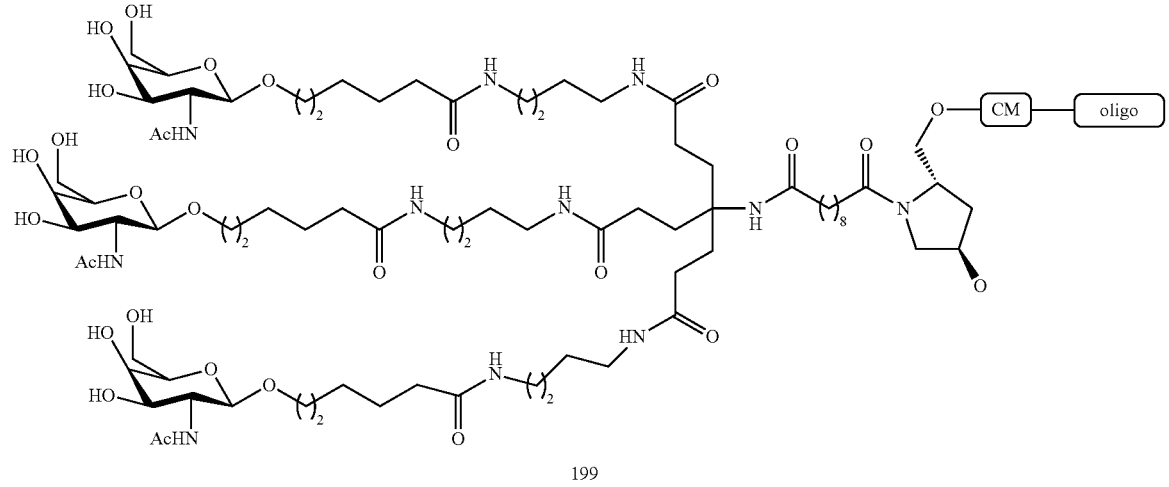

199

Oligomeric compound 199, comprising a GalNAc$_3$-16 conjugate group, is prepared using the general procedures illustrated in Examples 7 and 9. The GalNAc$_3$ cluster portion of the conjugate group GalNAc$_3$-16 (GalNAc$_3$-16$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-16 (GalNAc$_3$-16$_a$-CM-) is shown below:

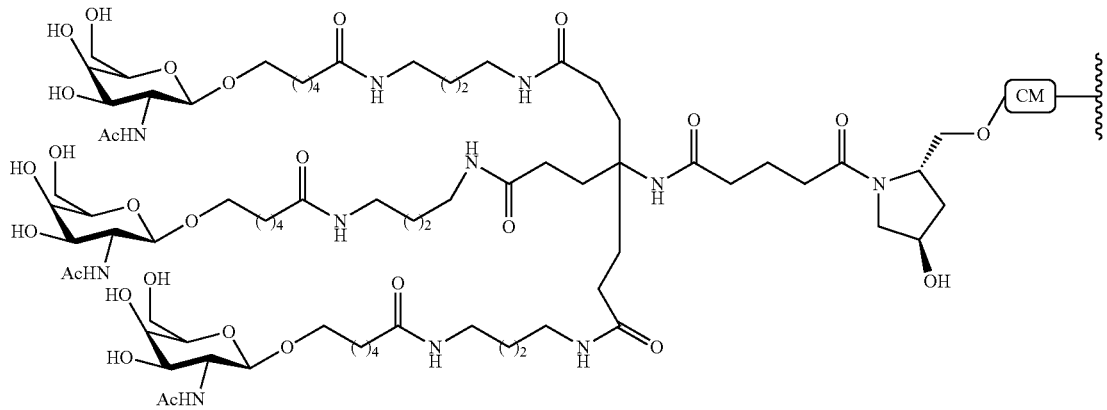

Example 68

Preparation of Oligomeric Compound 200 Comprising GalNAc$_3$-17

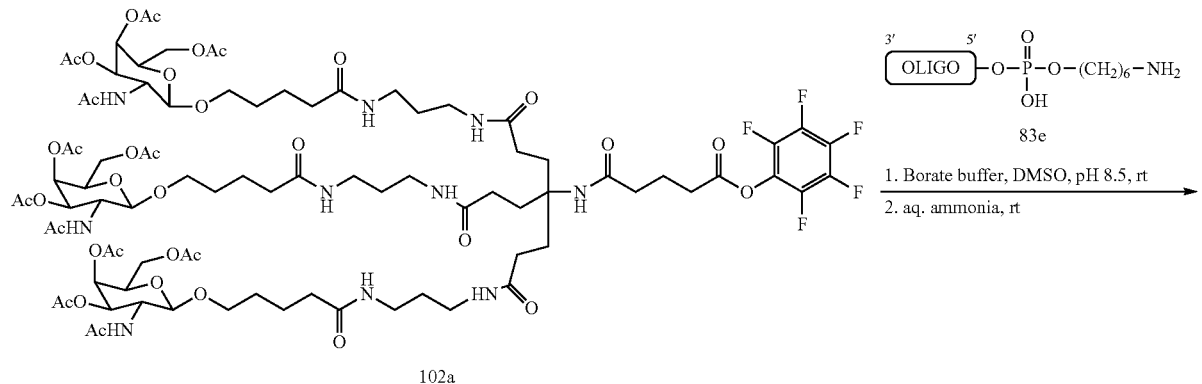

102a

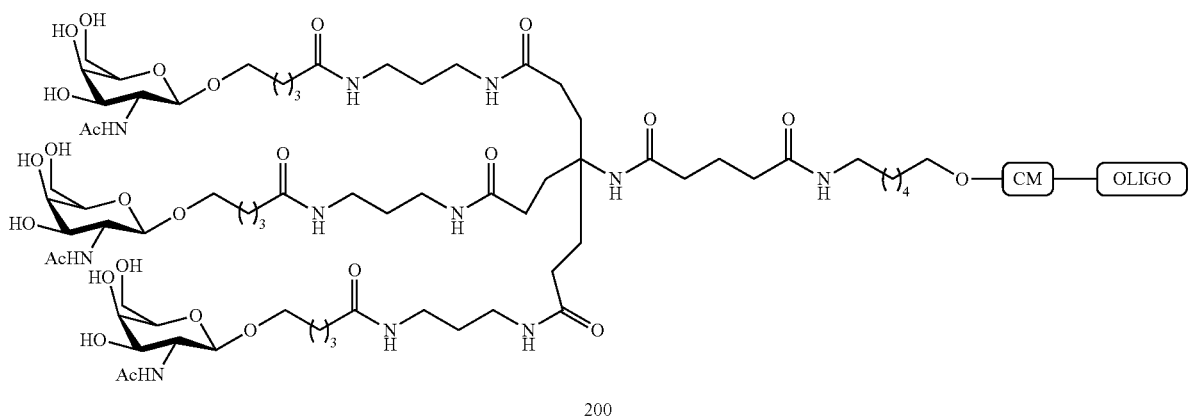

200

Oligomeric compound 200, comprising a GalNAc$_3$-17 conjugate group, was prepared using the general procedures illustrated in Example 46. The GalNAc$_3$ cluster portion of the conjugate group GalNAc$_3$-17 (GalNAc$_3$-17$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-17 (GalNAc$_3$-17$_a$-CM-) is shown below:

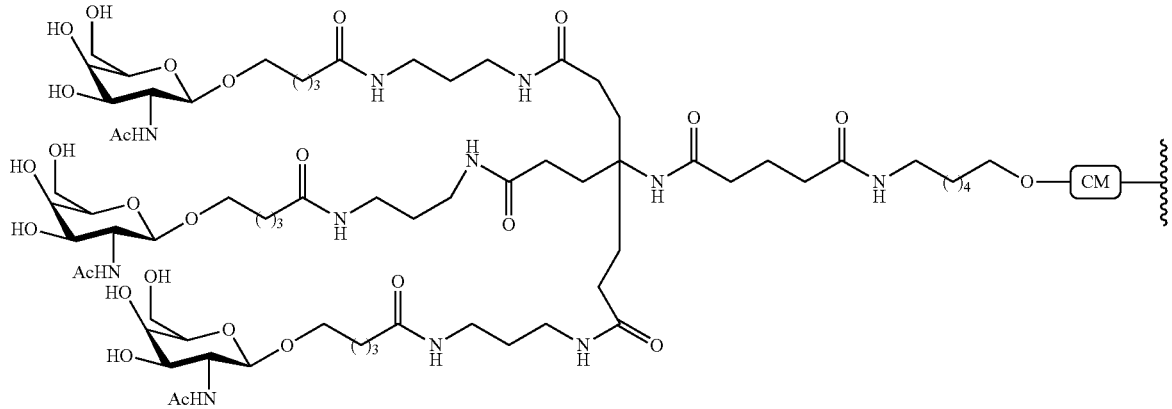

Example 69

Preparation of Oligomeric Compound 201 Comprising GalNAc$_3$-18

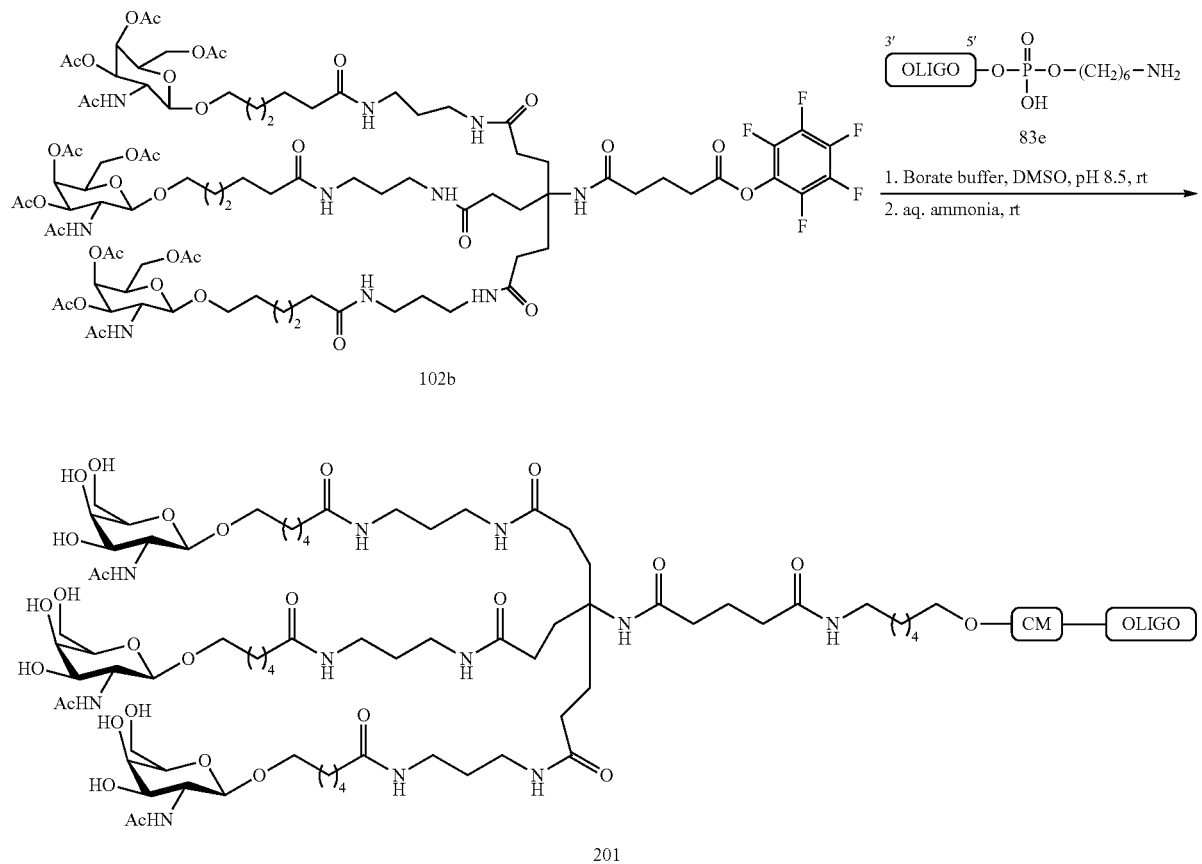

Oligomeric compound 201, comprising a GalNAc$_3$-18 conjugate group, was prepared using the general procedures illustrated in Example 46. The GalNAc$_3$ cluster portion of the conjugate group GalNAc$_3$-18 (GalNAc$_3$-18$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-18 (GalNAc$_3$-18$_a$-CM-) is shown below:

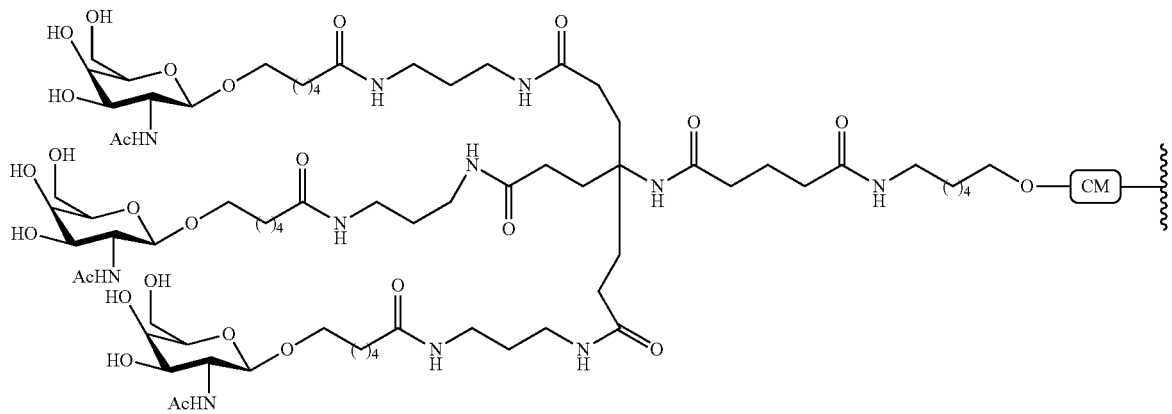

Example 70
Preparation of Oligomeric Compound 204 Comprising GalNAc$_3$-19
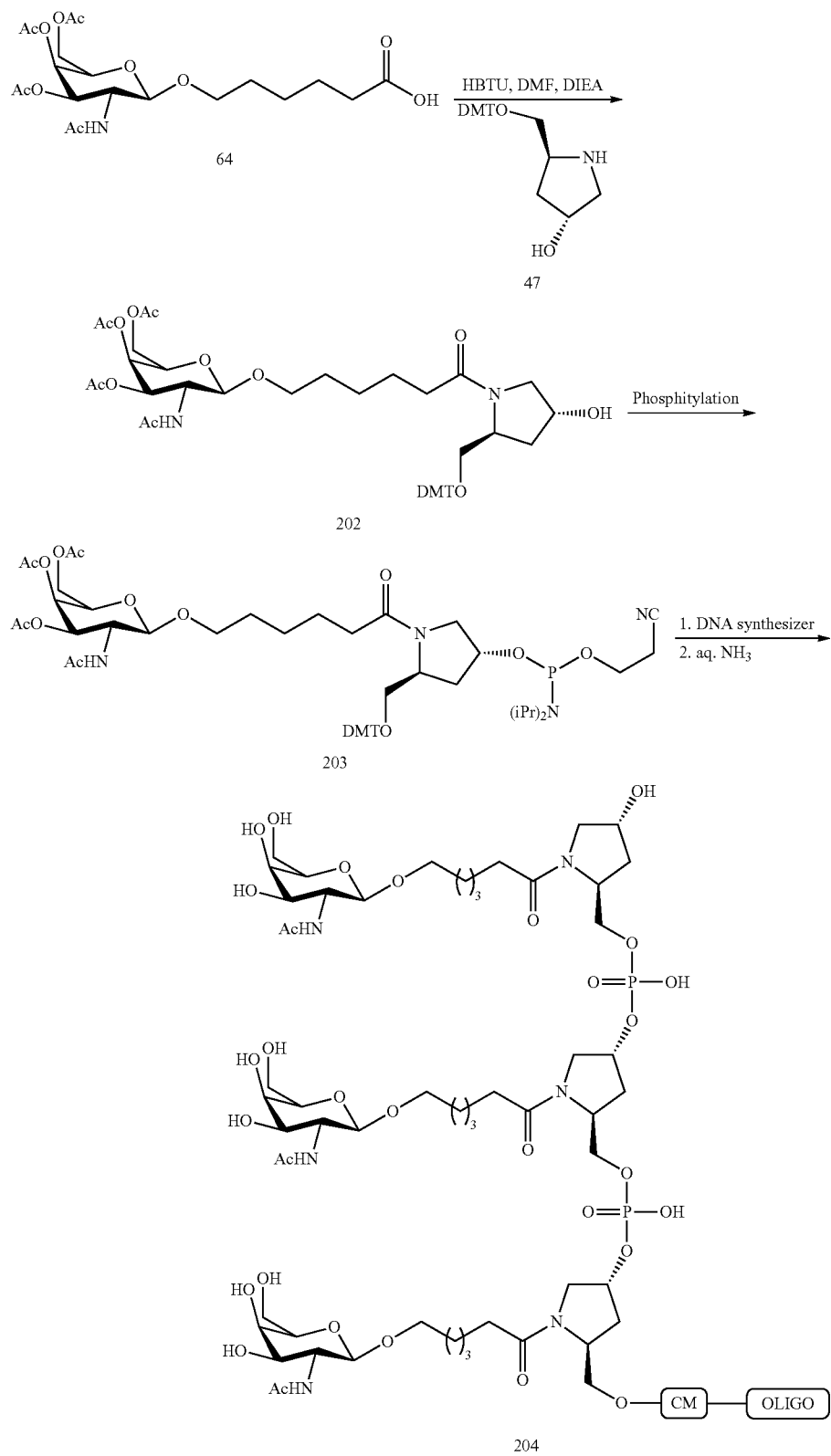

Oligomeric compound 204, comprising a GalNAc$_3$-19 conjugate group, was prepared from compound 64 using the general procedures illustrated in Example 52. The GalNAc$_3$ cluster portion of the conjugate group GalNAc$_3$-19 (GalNAc$_3$-19$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-19 (GalNAc$_3$-19$_a$-CM-) is shown below:

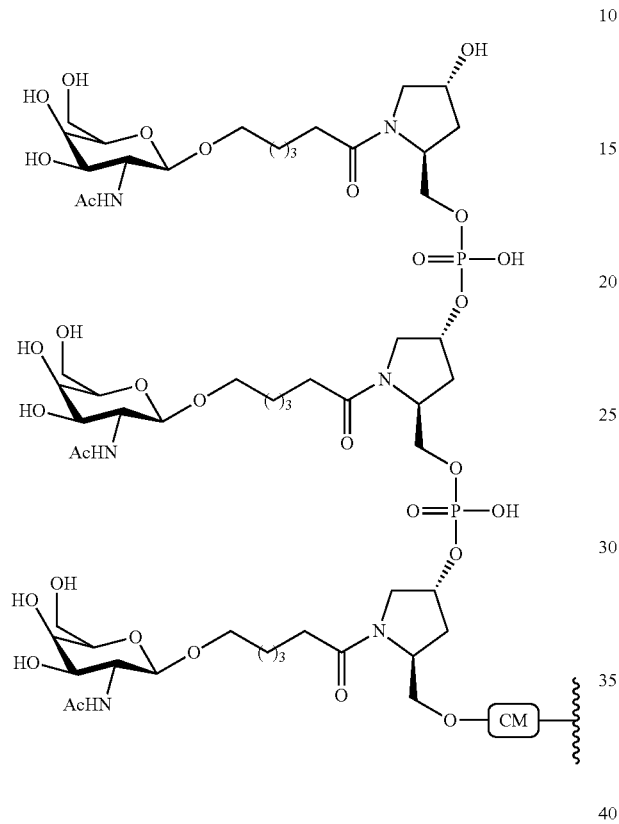

Example 71

Preparation of Oligomeric Compound 210
Comprising GalNAc$_3$-20

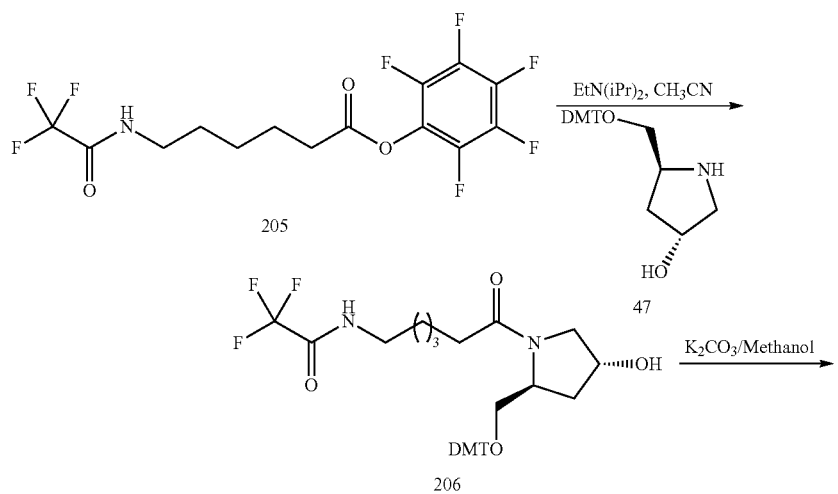

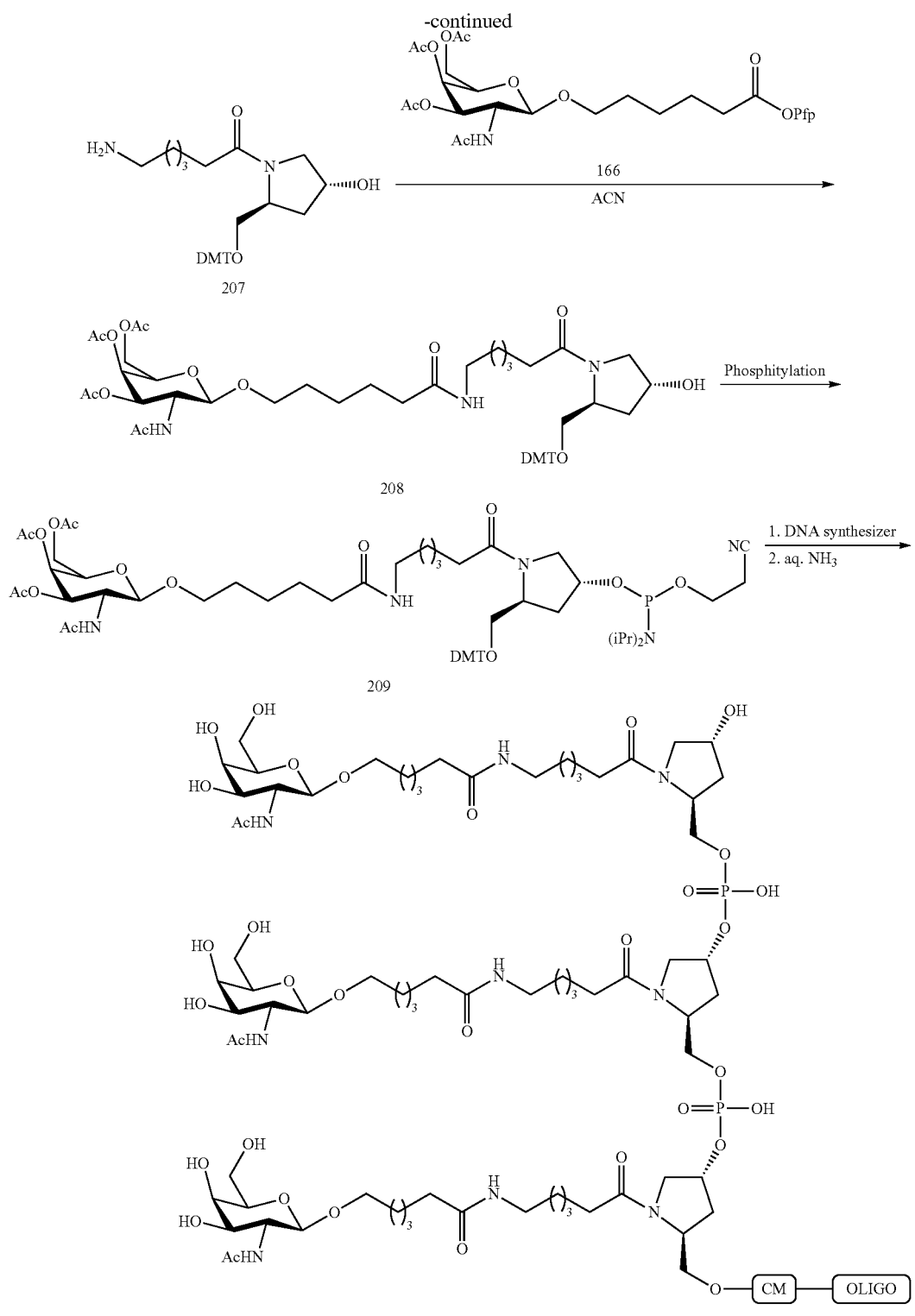

Compound 205 was prepared by adding PFP-TFA and DIEA to 6-(2,2,2-trifluoroacetamido)hexanoic acid in acetonitrile, which was prepared by adding triflic anhydride to 6-aminohexanoic acid. The reaction mixture was heated to 80° C., then lowered to rt. Oligomeric compound 210, comprising a GalNAc$_3$-20 conjugate group, was prepared from compound 208 using the general procedures illustrated in Example 52.

The GalNAc$_3$ cluster portion of the conjugate group Gal-NAc$_3$-20 (GalNAc$_3$-20$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-20 (GalNAc$_3$-20$_a$-CM-) is shown below:

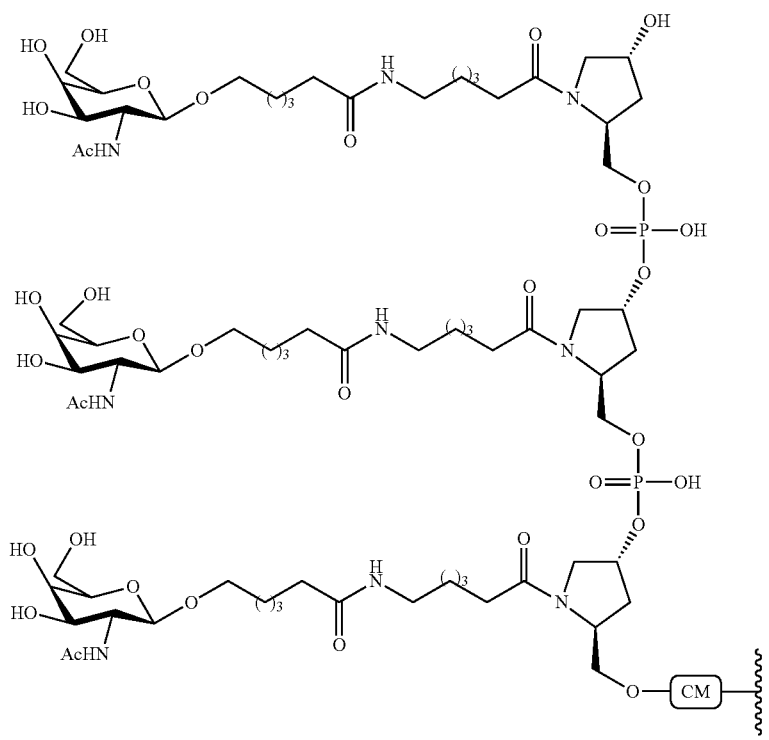
Example 72
Preparation of Oligomeric Compound 215
Comprising GalNAc₃-21
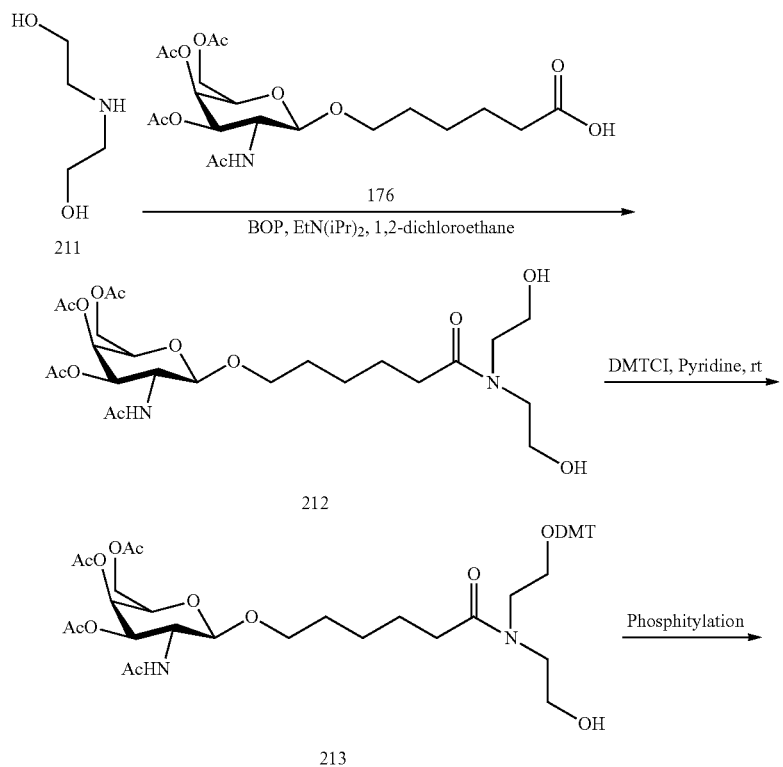

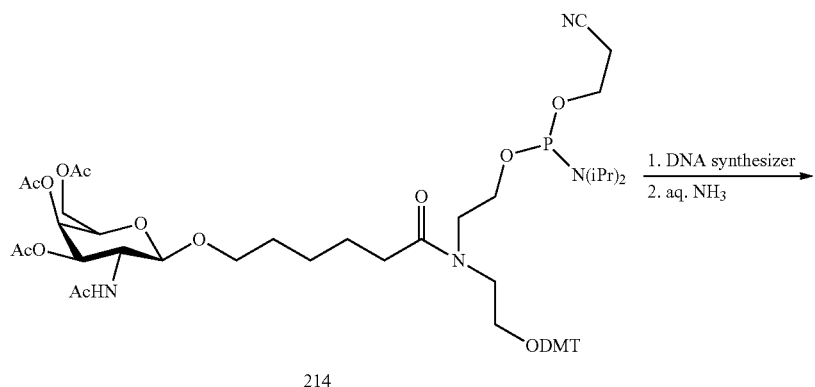

214

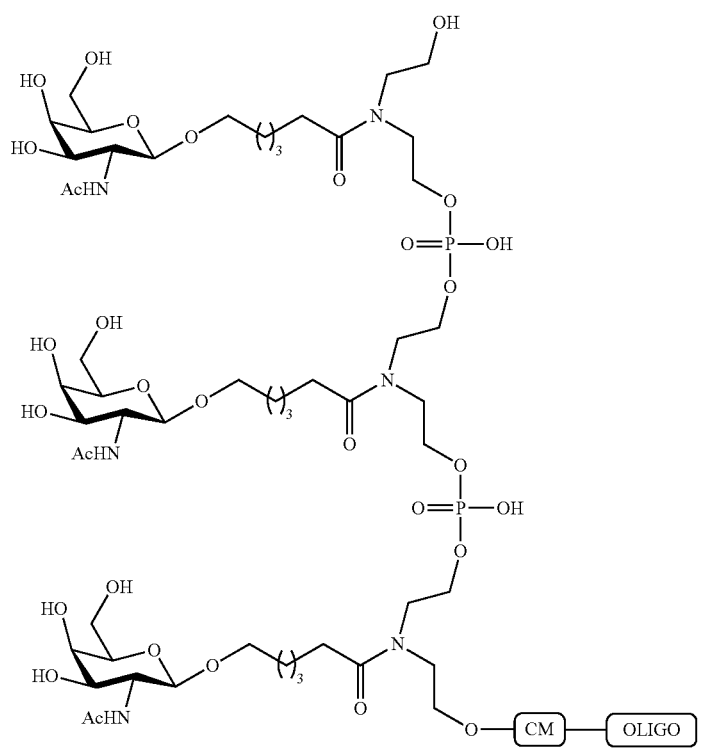

215

Compound 211 is commercially available. Oligomeric compound 215, comprising a GalNAc$_3$-21 conjugate group, was prepared from compound 213 using the general procedures illustrated in Example 52. The GalNAc$_3$ cluster portion of the conjugate group GalNAc$_3$-21 (GalNAc$_3$-21$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-21 (GalNAc$_3$-21$_a$-CM-) is shown below:

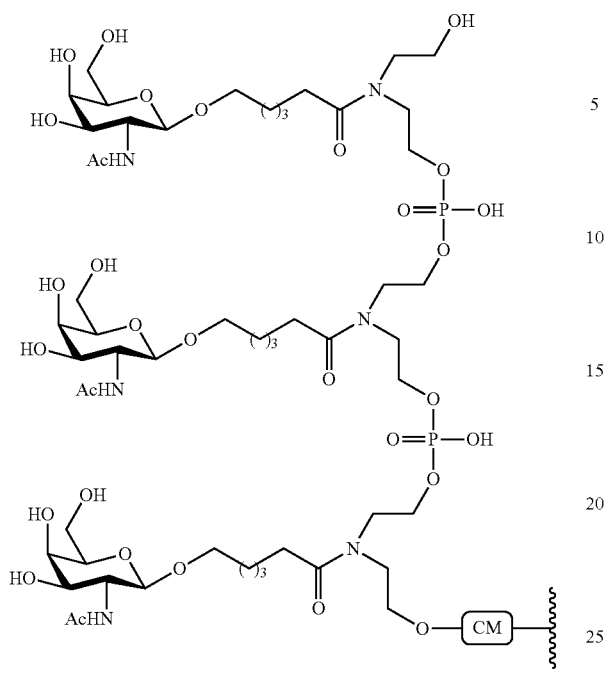
Example 73
Preparation of Oligomeric Compound 221 Comprising GalNAc₃-22
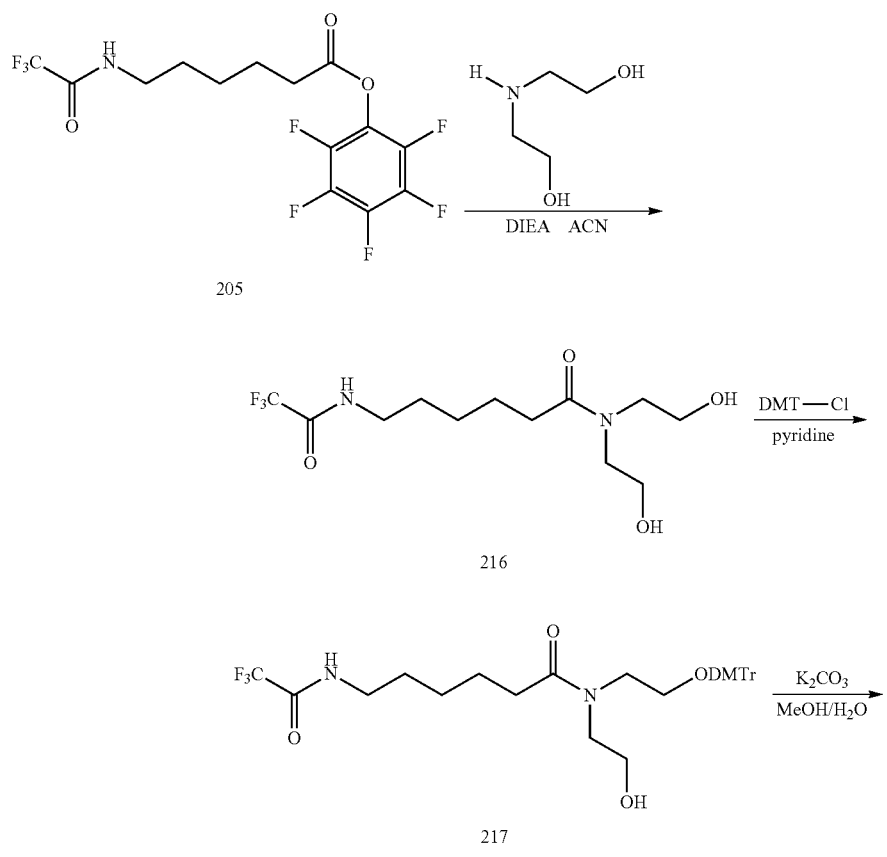

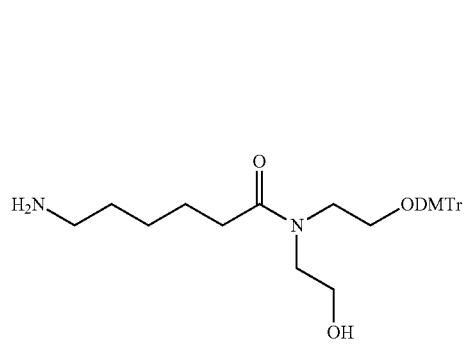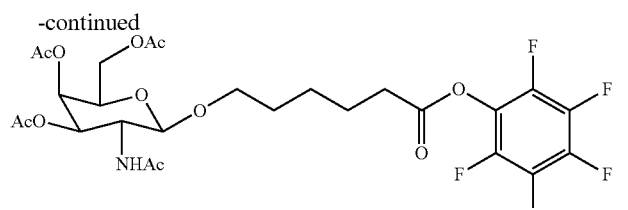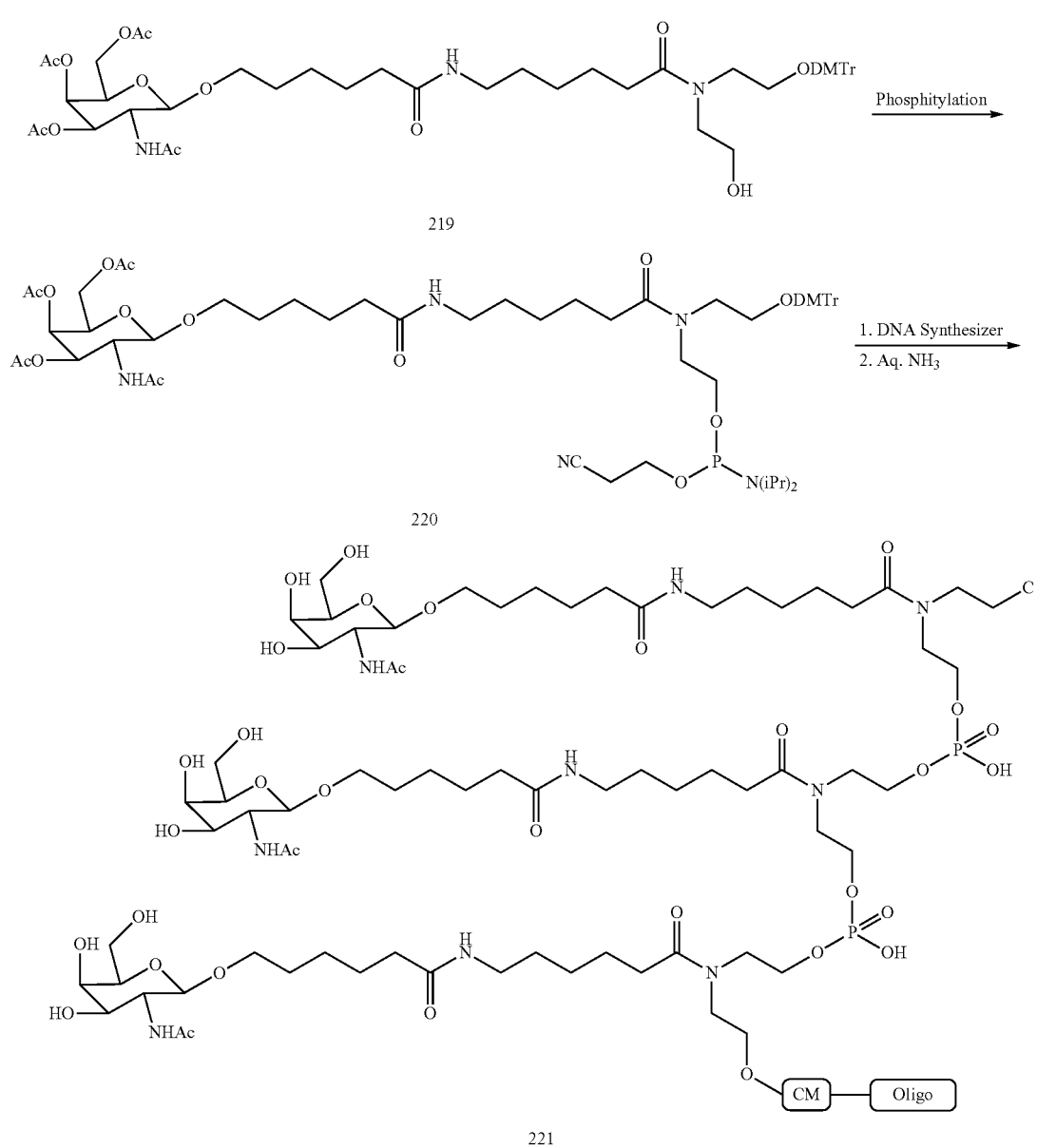

Compound 220 was prepared from compound 219 using diisopropylammonium tetrazolide. Oligomeric compound 221, comprising a GalNAc$_3$-21 conjugate group, is prepared from compound 220 using the general procedure illustrated in Example 52. The GalNAc$_3$ cluster portion of the conjugate group GalNAc$_3$-22 (GalNAc$_3$-22$_a$) can be combined with any cleavable moiety to provide a variety of conjugate groups. In certain embodiments, the cleavable moiety is —P(=O)(OH)-A$_d$-P(=O)(OH)—. The structure of GalNAc$_3$-22 (GalNAc$_3$-22$_a$-CM-) is shown below:

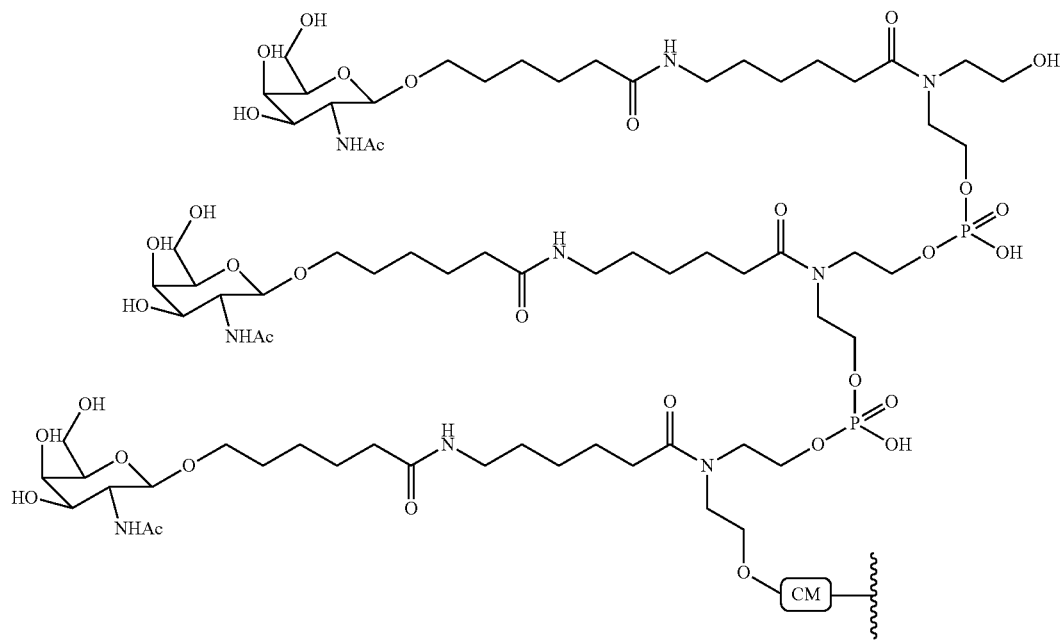

Example 74

Effect of Various Cleavable Moieties on Antisense Inhibition In Vivo by Oligonucleotides Targeting SRB-1 Comprising a 5'-GalNAc₃ Conjugate The oligonucleotides listed below were tested in a dose-dependent study for antisense inhibition of SRB-1 in mice. Each of the GalNAc₃ conjugate groups was attached at the 5' terminus of the respective oligonucleotide.

TABLE 60

Modified ASO targeting SRB-1

| ISIS No. | Sequence (5' to 3') | GalNAc₃ Cluster | CM | SEQ ID No. |
|---|---|---|---|---|
| 353382 | $G_{es}{}^mC_{es}T_{es}T_{es}{}^mC_{es}A_{ds}G_{ds}$ $T_{ds}{}^mC_{ds}A_{ds}T_{ds}G_{ds}A_{ds}{}^mC_{ds}$ $T_{ds}T_{es}{}^mC_{es}{}^mC_{es}T_{es}T_e$ | none | n/a | 4886 |
| 661161 | GalNAc₃-3$_{a'-o'}$A$_{do}$G$_{es}{}^mC_{es}$ $T_{es}T_{es}{}^mC_{es}A_{ds}G_{ds}T_{ds}{}^mC_{ds}$ $A_{ds}T_{ds}G_{ds}A_{ds}{}^mC_{ds}T_{ds}T_{es}{}^m$ $C_{es}{}^mC_{es}T_{es}T_e$ | GalNAc₃-3a | A$_d$ | 4888 |
| 666904 | GalNAc₃-3$_{a'-o'}$G$_{es}{}^mC_{es}T_{es}$ $T_{es}{}^mC_{es}A_{ds}G_{ds}T_{ds}{}^mC_{ds}A_{ds}$ $T_{ds}G_{ds}A_{ds}{}^mC_{ds}T_{ds}T_{es}{}^mC_{es}{}^m$ $C_{es}T_{es}T_e$ | GalNAc₃-3a | PO | 4886 |
| 675441 | GalNAc₃-17$_{a'-o'}$A$_{do}$G$_{es}{}^m$ $C_{es}T_{es}T_{es}{}^mC_{es}A_{ds}G_{ds}T_{ds}{}^m$ $C_{ds}A_{ds}T_{ds}G_{ds}A_{ds}{}^mC_{ds}T_{ds}$ $T_{es}{}^mC_{es}{}^mC_{es}T_{es}T_e$ | GalNAc₃-17a | A$_d$ | 4888 |
| 675442 | GalNAc₃-18$_{a'-o'}$A$_{do}$G$_{es}{}^m$ $C_{es}T_{es}T_{es}{}^mC_{es}A_{ds}G_{ds}T_{ds}{}^m$ $C_{ds}A_{ds}T_{ds}G_{ds}A_{ds}{}^mC_{ds}T_{ds}$ $T_{es}{}^mC_{es}{}^mC_{es}T_{es}T_e$ | GalNAc₃-18a | A$_d$ | 4888 |

In all tables, capital letters indicate the nucleobase for each nucleoside and $^mC$ indicates a 5-methyl cytosine. Subscripts: "e" indicates a 2'-MOE modified nucleoside; "d" indicates a β-D-2'-deoxyribonucleoside; "s" indicates a phosphorothioate internucleoside linkage (PS); "o" indicates a phosphodiester internucleoside linkage (PO); and "o'" indicates —O—P(=O)(OH)—. Conjugate groups are in bold.

The structure of GalNAc₃-3$_a$ was shown previously in Example 39. The structure of GalNAc₃-17a was shown previously in Example 68, and the structure of GalNAc₃-18a was shown in Example 69.

Treatment

Six to eight week old C57BL/6 mice (Jackson Laboratory, Bar Harbor, Me.) were injected subcutaneously once at the dosage shown below with an oligonucleotide listed in Table 60 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 61, treatment with antisense oligonucleotides lowered SRB-1 mRNA levels in a dose-dependent manner. The antisense oligonucleotides comprising a GalNAc conjugate showed similar potencies and were significantly more potent than the parent oligonucleotide lacking a GalNAc conjugate.

TABLE 61

SRB-1 mRNA (% Saline)

| ISIS No. | Dosage (mg/kg) | SRB-1 mRNA (% Saline) | GalNAc₃ Cluster | CM |
|---|---|---|---|---|
| Saline | n/a | 100.0 | n/a | n/a |
| 353382 | 3 | 79.38 | n/a | n/a |
|  | 10 | 68.67 |  |  |
|  | 30 | 40.70 |  |  |
| 661161 | 0.5 | 79.18 | GalNAc₃-3a | A$_d$ |
|  | 1.5 | 75.96 |  |  |
|  | 5 | 30.53 |  |  |
|  | 15 | 12.52 |  |  |

TABLE 61-continued

SRB-1 mRNA (% Saline)

| ISIS No. | Dosage (mg/kg) | SRB-1 mRNA (% Saline) | GalNAc$_3$ Cluster | CM |
|---|---|---|---|---|
| 666904 | 0.5 | 91.30 | GalNAc$_3$-3a | PO |
|  | 1.5 | 57.88 |  |  |
|  | 5 | 21.22 |  |  |
|  | 15 | 16.49 |  |  |
| 675441 | 0.5 | 76.71 | GalNAc$_3$-17a | A$_d$ |
|  | 1.5 | 63.63 |  |  |
|  | 15 | 13.49 |  |  |
| 675442 | 0.5 | 95.03 | GalNAc$_3$-18a | A$_d$ |
|  | 1.5 | 60.06 |  |  |
|  | 5 | 31.04 |  |  |
|  | 15 | 19.40 |  |  |

Liver transaminase levels, alanine aminotransferase (ALT) and aspartate aminotransferase (AST), in serum were measured relative to saline injected mice using standard protocols. Total bilirubin and BUN were also evaluated. The change in body weights was evaluated with no significant change from the saline group (data not shown). ALTs, ASTs, total bilirubin and BUN values are shown in Table 62 below.

TABLE 62

| ISIS No. | Dosage (mg/kg) | ALT (U/L) | AST (U/L) | Total Bilirubin (mg/dL) | BUN (mg/dL) | GalNac$_3$ Cluster | CM |
|---|---|---|---|---|---|---|---|
| Saline | n/a | 26 | 59 | 0.16 | 42 | n/a | n/a |
| 353382 | 3 | 23 | 58 | 0.18 | 39 | n/a | n/a |
|  | 10 | 28 | 58 | 0.16 | 43 |  |  |
|  | 30 | 20 | 48 | 0.12 | 34 |  |  |
| 661161 | 0.5 | 30 | 47 | 0.13 | 35 | GalNac$_3$-3a | A$_d$ |
|  | 1.5 | 23 | 53 | 0.14 | 37 |  |  |
|  | 5 | 26 | 48 | 0.15 | 39 |  |  |
|  | 15 | 32 | 57 | 0.15 | 42 |  |  |
| 666904 | 0.5 | 24 | 73 | 0.13 | 36 | GalNac$_3$-3a | PO |
|  | 1.5 | 21 | 48 | 0.12 | 32 |  |  |
|  | 5 | 19 | 49 | 0.14 | 33 |  |  |
|  | 15 | 20 | 52 | 0.15 | 26 |  |  |
| 675441 | 0.5 | 42 | 148 | 0.21 | 36 | GalNac$_3$-17a | A$_d$ |
|  | 1.5 | 60 | 95 | 0.16 | 34 |  |  |
|  | 5 | 27 | 75 | 0.14 | 37 |  |  |
|  | 15 | 24 | 61 | 0.14 | 36 |  |  |
| 675442 | 0.5 | 26 | 65 | 0.15 | 37 | GalNac$_3$-18a | A$_d$ |
|  | 1.5 | 25 | 64 | 0.15 | 43 |  |  |
|  | 5 | 27 | 69 | 0.15 | 37 |  |  |
|  | 15 | 30 | 84 | 0.14 | 37 |  |  |

Example 75

Pharmacokinetic Analysis of Oligonucleotides Comprising a 5'-Conjugate Group

The PK of the ASOs in Tables 54, 57 and 60 above was evaluated using liver samples that were obtained following the treatment procedures described in Examples 65, 66, and 74. The liver samples were minced and extracted using standard protocols and analyzed by IP-HPLC-MS alongside an internal standard. The combined tissue level (μm/g) of all metabolites was measured by integrating the appropriate UV peaks, and the tissue level of the full-length ASO missing the conjugate ("parent," which is Isis No. 353382 in this case) was measured using the appropriate extracted ion chromatograms (EIC).

TABLE 63

PK Analysis in Liver

| ISIS No. | Dosage (mg/kg) | Total Tissue Level by UV (μ/g) | Parent ASO Tissue Level by EIC (μg/g) | GalNAc$_3$ Cluster | CM |
|---|---|---|---|---|---|
| 353382 | 3 | 8.9 | 8.6 | n/a | n/a |
|  | 10 | 22.4 | 21.0 |  |  |
|  | 30 | 54.2 | 44.2 |  |  |
| 661161 | 5 | 32.4 | 20.7 | GalNAc$_3$-3a | A$_d$ |
|  | 15 | 63.2 | 44.1 |  |  |
| 671144 | 5 | 20.5 | 19.2 | GalNAc$_3$-12a | A$_d$ |
|  | 15 | 48.6 | 41.5 |  |  |
| 670061 | 5 | 31.6 | 28.0 | GalNAc$_3$-13a | A$_d$ |
|  | 15 | 67.6 | 55.5 |  |  |
| 671261 | 5 | 19.8 | 16.8 | GalNAc$_3$-14a | A$_d$ |
|  | 15 | 64.7 | 49.1 |  |  |
| 671262 | 5 | 18.5 | 7.4 | GalNAc$_3$-15a | A$_d$ |
|  | 15 | 52.3 | 24.2 |  |  |
| 670699 | 5 | 16.4 | 10.4 | GalNAc$_3$-3a | T$_d$ |
|  | 15 | 31.5 | 22.5 |  |  |
| 670700 | 5 | 19.3 | 10.9 | GalNAc$_3$-3a | A$_e$ |
|  | 15 | 38.1 | 20.0 |  |  |
| 670701 | 5 | 21.8 | 8.8 | GalNAc$_3$-3a | T$_e$ |
|  | 15 | 35.2 | 16.1 |  |  |
| 671165 | 5 | 27.1 | 26.5 | GalNAc$_3$-13a | A$_d$ |
|  | 15 | 48.3 | 44.3 |  |  |
| 666904 | 5 | 30.8 | 24.0 | GalNAc$_3$-3a | PO |
|  | 15 | 52.6 | 37.6 |  |  |
| 675441 | 5 | 25.4 | 19.0 | GalNAc$_3$-17a | A$_d$ |
|  | 15 | 54.2 | 42.1 |  |  |
| 675442 | 5 | 22.2 | 20.7 | GalNAc$_3$-18a | A$_d$ |
|  | 15 | 39.6 | 29.0 |  |  |

The results in Table 63 above show that there were greater liver tissue levels of the oligonucleotides comprising a GalNAc$_3$ conjugate group than of the parent oligonucleotide that does not comprise a GalNAc$_3$ conjugate group (ISIS 353382) 72 hours following oligonucleotide administration, particularly when taking into consideration the differences in dosing between the oligonucleotides with and without a GalNAc$_3$ conjugate group. Furthermore, by 72 hours, 40-98% of each oligonucleotide comprising a GalNAc$_3$ conjugate group was metabolized to the parent compound, indicating that the GalNAc$_3$ conjugate groups were cleaved from the oligonucleotides.

Example 76

Preparation of Oligomeric Compound 230 Comprising GalNAc$_3$-23

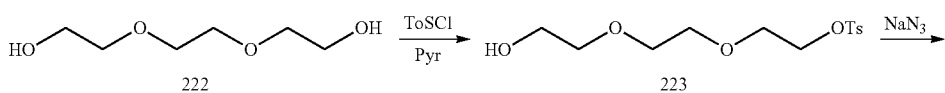

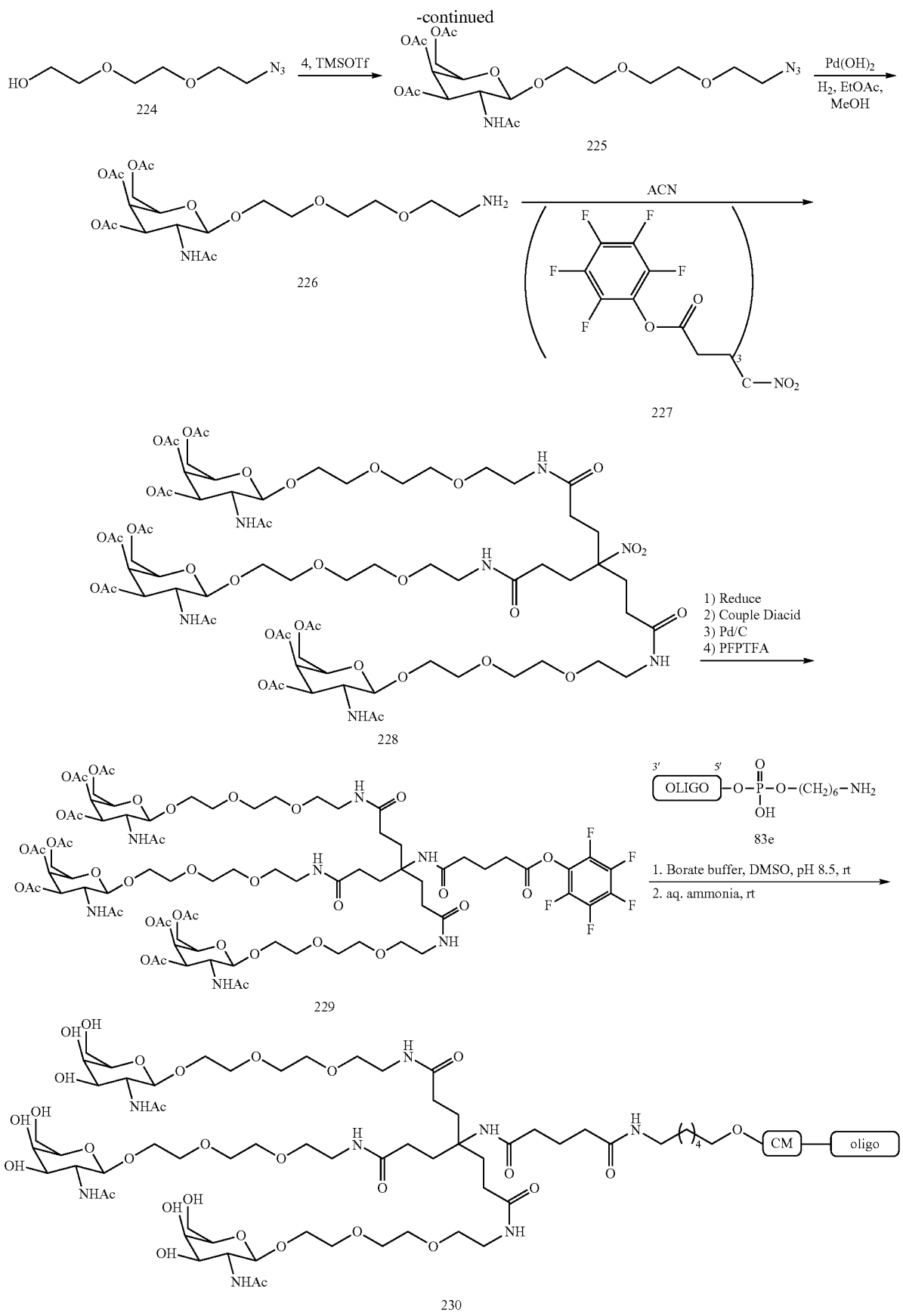

Compound 222 is commercially available. 44.48 ml (0.33 mol) of compound 222 was treated with tosyl chloride (25.39 g, 0.13 mol) in pyridine (500 mL) for 16 hours. The reaction was then evaporated to an oil, dissolved in EtOAc and washed with water, sat. NaHCO$_3$, brine, and dried over Na$_2$SO$_4$. The ethyl acetate was concentrated to dryness and purified by column chromatography, eluted with EtOAc/hexanes (1:1) followed by 10% methanol in CH$_2$Cl$_2$ to give compound 223 as a colorless oil. LCMS and NMR were consistent with the structure. 10 g (32.86 mmol) of 1-Tosyltriethylene glycol (compound 223) was treated with sodium azide (10.68 g, 164.28 mmol) in DMSO (100 mL) at room temperature for 17 hours. The reaction mixture was then poured onto water, and extracted with EtOAc. The organic layer was washed with water three times and dried over Na$_2$SO$_4$. The organic layer was concentrated to dryness to give 5.3 g of compound 224 (92%). LCMS and NMR were consistent with the structure. 1-Azidotriethylene glycol (compound 224, 5.53 g, 23.69 mmol) and compound 4 (6 g, 18.22 mmol) were treated with 4 A molecular sieves (5 g), and TMSOTf (1.65 ml, 9.11 mmol) in dichloromethane (100 mL) under an inert atmosphere. After 14 hours, the reaction was filtered to remove the sieves, and the organic layer was washed with sat. NaHCO$_3$, water, brine, and dried over Na$_2$SO$_4$. The organic layer was concentrated to dryness and purified by column chromatography, eluted with a gradient of 2 to 4% methanol in dichloromethane to give compound 225. LCMS and NMR were consistent with the structure. Compound 225 (11.9 g, 23.59 mmol) was hydrogenated in EtOAc/Methanol (4:1, 250 mL) over Pearlman's catalyst. After 8 hours, the catalyst was removed by filtration and the solvents removed to dryness to give compound 226. LCMS and NMR were consistent with the structure.

In order to generate compound 227, a solution of nitromethanetrispropionic acid (4.17 g, 15.04 mmol) and Hunig's base (10.3 ml, 60.17 mmol) in DMF (100 mL) were treated dropwise with pentaflourotrifluoro acetate (9.05 ml, 52.65 mmol). After 30 minutes, the reaction was poured onto ice water and extracted with EtOAc. The organic layer was washed with water, brine, and dried over Na$_2$SO$_4$. The organic layer was concentrated to dryness and then recrystallized from heptane to give compound 227 as a white solid. LCMS and NMR were consistent with the structure. Compound 227 (1.5 g, 1.93 mmol) and compound 226 (3.7 g, 7.74 mmol) were stirred at room temperature in acetonitrile (15 mL) for 2 hours. The reaction was then evaporated to dryness and purified by column chromatography, eluting with a gradient of 2 to 10% methanol in dichloromethane to give compound 228. LCMS and NMR were consistent with the structure. Compound 228 (1.7 g, 1.02 mmol) was treated with Raney Nickel (about 2 g wet) in ethanol (100 mL) in an atmosphere of hydrogen. After 12 hours, the catalyst was removed by filtration and the organic layer was evaporated to a solid that was used directly in the next step. LCMS and NMR were consistent with the structure. This solid (0.87 g, 0.53 mmol) was treated with benzylglutaric acid (0.18 g, 0.8 mmol), HBTU (0.3 g, 0.8 mmol) and DIEA (273.7 µl, 1.6 mmol) in DMF (5 mL). After 16 hours, the DMF was removed under reduced pressure at 65° C. to an oil, and the oil was dissolved in dichloromethane. The organic layer was washed with sat. NaHCO$_3$, brine, and dried over Na$_2$SO$_4$. After evaporation of the organic layer, the compound was purified by column chromatography and eluted with a gradient of 2 to 20% methanol in dichloromethane to give the coupled product. LCMS and NMR were consistent with the structure. The benzyl ester was deprotected with Pearlman's catalyst under a hydrogen atmosphere for 1 hour. The catalyst was them removed by filtration and the solvents removed to dryness to give the acid. LCMS and NMR were consistent with the structure. The acid (486 mg, 0.27 mmol) was dissolved in dry DMF (3 mL). Pyridine (53.61 µl, 0.66 mmol) was added and the reaction was purged with argon. Pentaflourotriflouro acetate (46.39 µl, 0.4 mmol) was slowly added to the reaction mixture. The color of the reaction changed from pale yellow to burgundy, and gave off a light smoke which was blown away with a stream of argon. The reaction was allowed to stir at room temperature for one hour (completion of reaction was confirmed by LCMS). The solvent was removed under reduced pressure (rotovap) at 70° C. The residue was diluted with DCM and washed with 1N NaHSO$_4$, brine, saturated sodium bicarbonate and brine again. The organics were dried over Na$_2$SO$_4$, filtered, and were concentrated to dryness to give 225 mg of compound 229 as a brittle yellow foam. LCMS and NMR were consistent with the structure.

Oligomeric compound 230, comprising a GalNAc$_3$-23 conjugate group, was prepared from compound 229 using the general procedure illustrated in Example 46. The GalNAc$_3$ cluster portion of the GalNAc$_3$-23 conjugate group (GalNAc$_3$-23$_a$) can be combined with any cleavable moiety to provide a variety of conjugate groups. The structure of GalNAc$_3$-23 (GalNAc$_3$-23$_a$-CM) is shown below:

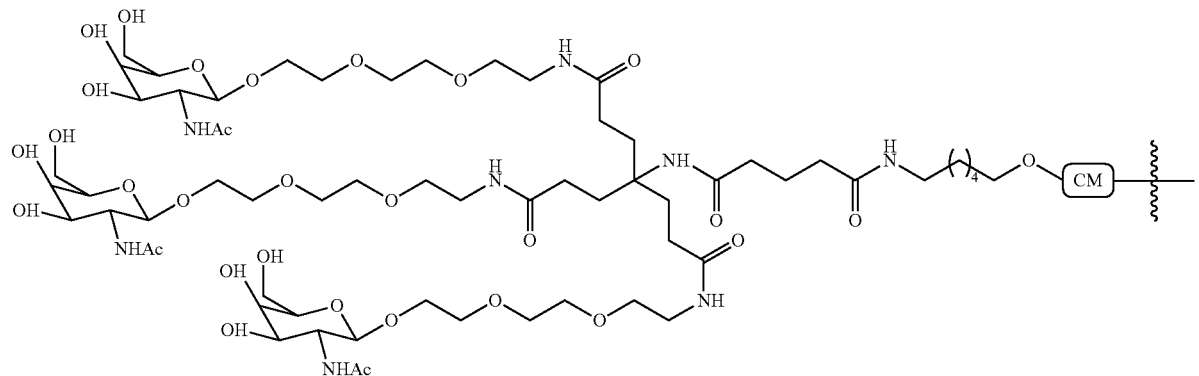

Example 77

Antisense Inhibition In Vivo by Oligonucleotides Targeting SRB-1 Comprising a GalNAc$_3$ Conjugate The oligonucleotides listed below were tested in a dose-dependent study for antisense inhibition of SRB-1 in mice.

TABLE 64

Modified ASO targeting SRB-1

| ISIS No. | Sequence (5' to 3') | GalNAc$_3$ Cluster | CM | SEQ ID No. |
|---|---|---|---|---|
| 661161 | GalNAc$_3$-3$_a$-$_o'$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | A$_d$ | 4888 |
| 666904 | GalNAc$_3$-3$_a$-$_o'$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | PO | 4886 |
| 673502 | GalNAc$_3$-10$_a$-$_o'$A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | GalNAc$_3$-10a | A$_d$ | 4888 |
| 677844 | GalNAc$_3$-9$_a$-$_o'$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-9a | A$_d$ | 4888 |
| 677843 | GalNAc$_3$-23$_a$-$_o'$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-23a | A$_d$ | 4888 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-1$_a$ | GalNAc$_3$-1a | A$_d$ | 4887 |
| 677841 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-19$_a$ | GalNAc$_3$-19a | A$_d$ | 4887 |
| 677842 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do'}$-GalNAc$_3$-20$_a$ | GalNAc$_3$-20a | A$_d$ | 4887 |

The structure of GalNAc$_3$-1$_a$ was shown previously in Example 9, GalNAc$_3$-3$_a$ was shown in Example 39, GalNAc$_3$-9a was shown in Example 52, GalNAc$_3$-10a was shown in Example 46, GalNAc$_3$-19$_a$ was shown in Example 70, GalNAc$_3$-20$_a$ was shown in Example 71, and GalNAc$_3$-23$_a$ was shown in Example 76.

Treatment

Six to eight week old C57BL/6 mice (Jackson Laboratory, Bar Harbor, Me.) were each injected subcutaneously once at a dosage shown below with an oligonucleotide listed in Table 64 or with saline. Each treatment group consisted of 4 animals. The mice were sacrificed 72 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of SRB-1 mRNA levels for each treatment group, normalized to the saline control.

As illustrated in Table 65, treatment with antisense oligonucleotides lowered SRB-1 mRNA levels in a dose-dependent manner.

TABLE 65

SRB-1 mRNA (% Saline)

| ISIS No. | Dosage (mg/kg) | SRB-1 mRNA (% Saline) | GalNAc$_3$ Cluster | CM |
|---|---|---|---|---|
| Saline | n/a | 100.0 | n/a | n/a |
| 661161 | 0.5 | 89.18 | GalNAc$_3$-3a | A$_d$ |
|  | 1.5 | 77.02 |  |  |
|  | 5 | 29.10 |  |  |
|  | 15 | 12.64 |  |  |
| 666904 | 0.5 | 93.11 | GalNAc$_3$-3a | PO |
|  | 1.5 | 55.85 |  |  |
|  | 5 | 21.29 |  |  |
|  | 15 | 13.43 |  |  |
| 673502 | 0.5 | 77.75 | GalNAc$_3$-10a | A$_d$ |
|  | 1.5 | 41.05 |  |  |
|  | 5 | 19.27 |  |  |
|  | 15 | 14.41 |  |  |
| 677844 | 0.5 | 87.65 | GalNAc$_3$-9a | A$_d$ |
|  | 1.5 | 93.04 |  |  |
|  | 5 | 40.77 |  |  |
|  | 15 | 16.95 |  |  |
| 677843 | 0.5 | 102.28 | GalNAc$_3$-23a | A$_d$ |
|  | 1.5 | 70.51 |  |  |
|  | 5 | 30.68 |  |  |
|  | 15 | 13.26 |  |  |
| 655861 | 0.5 | 79.72 | GalNAc$_3$-1a | A$_d$ |
|  | 1.5 | 55.48 |  |  |
|  | 5 | 26.99 |  |  |
|  | 15 | 17.58 |  |  |
| 677841 | 0.5 | 67.43 | GalNAc$_3$-19a | A$_d$ |
|  | 1.5 | 45.13 |  |  |
|  | 5 | 27.02 |  |  |
|  | 15 | 12.41 |  |  |
| 677842 | 0.5 | 64.13 | GalNAc$_3$-20a | A$_d$ |
|  | 1.5 | 53.56 |  |  |
|  | 5 | 20.47 |  |  |
|  | 15 | 10.23 |  |  |

Liver transaminase levels, alanine aminotransferase (ALT) and aspartate aminotransferase (AST), in serum were also measured using standard protocols. Total bilirubin and BUN were also evaluated. Changes in body weights were evaluated, with no significant change from the saline group (data not shown). ALTs, ASTs, total bilirubin and BUN values are shown in Table 66 below.

TABLE 66

| ISIS No. | Dosage (mg/kg) | ALT (U/L) | AST (U/L) | Total Bilirubin (mg/dL) | BUN (mg/dL) | GalNac$_3$ Cluster | CM |
|---|---|---|---|---|---|---|---|
| Saline | n/a | 21 | 45 | 0.13 | 34 | n/a | n/a |
| 661161 | 0.5 | 28 | 51 | 0.14 | 39 | GalNac$_3$-3a | A$_d$ |
|  | 1.5 | 23 | 42 | 0.13 | 39 |  |  |
|  | 5 | 22 | 59 | 0.13 | 37 |  |  |
|  | 15 | 21 | 56 | 0.15 | 35 |  |  |
| 666904 | 0.5 | 24 | 56 | 0.14 | 37 | GalNac$_3$-3a | PO |
|  | 1.5 | 26 | 68 | 0.15 | 35 |  |  |
|  | 5 | 23 | 77 | 0.14 | 34 |  |  |
|  | 15 | 24 | 60 | 0.13 | 35 |  |  |
| 673502 | 0.5 | 24 | 59 | 0.16 | 34 | GalNac$_3$-10a | A$_d$ |
|  | 1.5 | 20 | 46 | 0.17 | 32 |  |  |
|  | 5 | 24 | 45 | 0.12 | 31 |  |  |
|  | 15 | 24 | 47 | 0.13 | 34 |  |  |
| 677844 | 0.5 | 25 | 61 | 0.14 | 37 | GalNac$_3$-9a | A$_d$ |
|  | 1.5 | 23 | 64 | 0.17 | 33 |  |  |
|  | 5 | 25 | 58 | 0.13 | 35 |  |  |
|  | 15 | 22 | 65 | 0.14 | 34 |  |  |
| 677843 | 0.5 | 53 | 53 | 0.13 | 35 | GalNac$_3$-23a | A$_d$ |
|  | 1.5 | 25 | 54 | 0.13 | 34 |  |  |
|  | 5 | 21 | 60 | 0.15 | 34 |  |  |
|  | 15 | 22 | 43 | 0.12 | 38 |  |  |
| 655861 | 0.5 | 21 | 48 | 0.15 | 33 | GalNac$_3$-1a | A$_d$ |
|  | 1.5 | 28 | 54 | 0.12 | 35 |  |  |
|  | 5 | 22 | 60 | 0.13 | 36 |  |  |
|  | 15 | 21 | 55 | 0.17 | 30 |  |  |
| 677841 | 0.5 | 32 | 54 | 0.13 | 34 | GalNac$_3$-19a | A$_d$ |
|  | 1.5 | 24 | 56 | 0.14 | 34 |  |  |
|  | 5 | 23 | 92 | 0.18 | 31 |  |  |
|  | 15 | 24 | 58 | 0.15 | 31 |  |  |

TABLE 66-continued

| ISIS No. | Dosage (mg/kg) | ALT (U/L) | AST (U/L) | Total Bilirubin (mg/dL) | BUN (mg/dL) | GalNac$_3$ Cluster | CM |
|---|---|---|---|---|---|---|---|
| 677842 | 0.5 | 23 | 61 | 0.15 | 35 | GalNac$_3$-20a | A$_d$ |
|  | 1.5 | 24 | 57 | 0.14 | 34 |  |  |
|  | 5 | 41 | 62 | 0.15 | 35 |  |  |
|  | 15 | 24 | 37 | 0.14 | 32 |  |  |

Example 78

Antisense Inhibition In Vivo by Oligonucleotides Targeting Angiotensinogen Comprising a GalNAc$_3$ Conjugate The oligonucleotides listed below were tested in a dose-dependent study for antisense inhibition of Angiotensinogen (AGT) in normotensive Sprague Dawley rats.

TABLE 67

Modified ASOs targeting AGT

| ISIS No. | Sequences (5' to 3') | GalNAc$_3$ Cluster | CM | SEQ ID No. |
|---|---|---|---|---|
| 552668 | $^mC_{es}A_{es}{}^mC_{es}T_{es}G_{es}A_{ds}T_{ds}T_{ds}T_{ds}T_{ds}T_{ds}G_{ds}{}^mC_{ds}{}^mC_{ds}{}^mC_{ds}A_{es}G_{es}G_{es}A_{es}T_e$ | n/a | n/a | 4892 |
| 669509 | $^mC_{es}A_{es}{}^mC_{es}T_{es}G_{es}A_{ds}T_{ds}T_{ds}T_{ds}T_{ds}T_{ds}G_{ds}{}^mC_{ds}{}^mC_{ds}{}^mC_{ds}A_{es}G_{es}G_{es}A_{es}T_{eo}A_{do}$-GalNAc$_3$-1$_a$ | GalNAc$_3$-1$_a$ | A$_d$ | 4893 |

The structure of GalNAc$_3$-1$_a$ was shown previously in Example 9.

Treatment

Six week old, male Sprague Dawley rats were each injected subcutaneously once per week at a dosage shown below, for a total of three doses, with an oligonucleotide listed in Table 67 or with PBS. Each treatment group consisted of 4 animals. The rats were sacrificed 72 hours following the final dose. AGT liver mRNA levels were measured using real-time PCR and RIBOGREEN® RNA quantification reagent (Molecular Probes, Inc. Eugene, Oreg.) according to standard protocols. AGT plasma protein levels were measured using the Total Angiotensinogen ELISA (Catalog # JP27412, IBL International, Toronto, ON) with plasma diluted 1:20,000. The results below are presented as the average percent of AGT mRNA levels in liver or AGT protein levels in plasma for each treatment group, normalized to the PBS control.

As illustrated in Table 68, treatment with antisense oligonucleotides lowered AGT liver mRNA and plasma protein levels in a dose-dependent manner, and the oligonucleotide comprising a GalNAc conjugate was significantly more potent than the parent oligonucleotide lacking a GalNAc conjugate.

TABLE 68

AGT liver mRNA and plasma protein levels

| ISIS No. | Dosage (mg/kg) | AGT liver mRNA (% PBS) | AGT plasma protein (% PBS) | GalNAc$_3$ Cluster | CM |
|---|---|---|---|---|---|
| PBS | n/a | 100 | 100 | n/a | n/a |
| 552668 | 3 | 95 | 122 | n/a | n/a |
|  | 10 | 85 | 97 |  |  |
|  | 30 | 46 | 79 |  |  |
|  | 90 | 8 | 11 |  |  |
| 669509 | 0.3 | 95 | 70 | GalNAc$_3$-1a | A$_d$ |
|  | 1 | 95 | 129 |  |  |
|  | 3 | 62 | 97 |  |  |
|  | 10 | 9 | 23 |  |  |

Liver transaminase levels, alanine aminotransferase (ALT) and aspartate aminotransferase (AST), in plasma and body weights were also measured at time of sacrifice using standard protocols. The results are shown in Table 69 below.

TABLE 69

Liver transaminase levels and rat body weights

| ISIS No. | Dosage (mg/kg) | ALT (U/L) | AST (U/L) | Body Weight (% of baseline) | GalNac$_3$ Cluster | CM |
|---|---|---|---|---|---|---|
| PBS | n/a | 51 | 81 | 186 | n/a | n/a |
| 552668 | 3 | 54 | 93 | 183 | n/a | n/a |
|  | 10 | 51 | 93 | 194 |  |  |
|  | 30 | 59 | 99 | 182 |  |  |
|  | 90 | 56 | 78 | 170 |  |  |
| 669509 | 0.3 | 53 | 90 | 190 | GalNAc$_3$-1a | A$_d$ |
|  | 1 | 51 | 93 | 192 |  |  |
|  | 3 | 48 | 85 | 189 |  |  |
|  | 10 | 56 | 95 | 189 |  |  |

Example 79

Duration of Action In Vivo of Oligonucleotides Targeting APOC-III Comprising a GalNAc$_3$ Conjugate The oligonucleotides listed in Table 70 below were tested in a single dose study for duration of action in mice.

TABLE 70

Modified ASOs targeting APOC-III

| ISIS No. | Sequences (5' to 3') | GalNAc$_3$ Cluster | CM | SEQ ID No. |
|---|---|---|---|---|
| 304801 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | n/a | n/a | 4878 |
| 647535 | A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_{eo}$A$_{do'}$-GalNAc$_3$-1$_a$ | GalNAc$_3$-1a | A$_d$ | 4879 |
| 663083 | GalNAc$_3$-3$_{a-o'}$A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-3a | A$_d$ | 4894 |
| 674449 | GalNAc$_3$-7$_{a-o'}$A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-7a | A$_d$ | 4894 |
| 674450 | GalNAc$_3$-10$_{a-o'}$A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-10a | A$_d$ | 4894 |
| 674451 | GalNAc$_3$-13$_{a-o'}$A$_{do}$A$_{es}$G$_{es}$$^m$C$_{es}$T$_{es}$T$_{es}$$^m$C$_{ds}$T$_{ds}$T$_{ds}$G$_{ds}$T$_{ds}$$^m$C$_{ds}$$^m$C$_{ds}$A$_{ds}$G$_{ds}$$^m$C$_{ds}$T$_{es}$T$_{es}$T$_{es}$A$_{es}$T$_e$ | GalNAc$_3$-13a | A$_d$ | 4894 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six to eight week old transgenic mice that express human APOC-III were each injected subcutaneously once with an oligonucleotide listed in Table 70 or with PBS. Each treatment group consisted of 3 animals. Blood was drawn before dosing to determine baseline and at 72 hours, 1 week, 2 weeks, 3 weeks, 4 weeks, 5 weeks, and 6 weeks following the dose. Plasma triglyceride and APOC-III protein levels were measured as described in Example 20. The results below are presented as the average percent of plasma triglyceride and APOC-III levels for each treatment group, normalized to baseline levels, showing that the oligonucleotides comprising a GalNAc conjugate group exhibited a longer duration of action than the parent oligonucleotide without a conjugate group (ISIS 304801) even though the dosage of the parent was three times the dosage of the oligonucleotides comprising a GalNAc conjugate group.

TABLE 71

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 97 | 102 | n/a | n/a |
| | | 7 | 101 | 98 | | |
| | | 14 | 108 | 98 | | |
| | | 21 | 107 | 107 | | |
| | | 28 | 94 | 91 | | |
| | | 35 | 88 | 90 | | |
| | | 42 | 91 | 105 | | |
| 304801 | 30 | 3 | 40 | 34 | n/a | n/a |
| | | 7 | 41 | 37 | | |
| | | 14 | 50 | 57 | | |
| | | 21 | 50 | 50 | | |
| | | 28 | 57 | 73 | | |
| | | 35 | 68 | 70 | | |
| | | 42 | 75 | 93 | | |
| 647535 | 10 | 3 | 36 | 37 | GalNac$_3$-1a | A$_d$ |
| | | 7 | 39 | 47 | | |
| | | 14 | 40 | 45 | | |
| | | 21 | 41 | 41 | | |
| | | 28 | 42 | 62 | | |
| | | 35 | 69 | 69 | | |
| | | 42 | 85 | 102 | | |

TABLE 71-continued

Plasma triglyceride and APOC-III protein levels in transgenic mice

| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| 663083 | 10 | 3 | 24 | 18 | GalNac$_3$-3a | A$_d$ |
| | | 7 | 28 | 23 | | |
| | | 14 | 25 | 27 | | |
| | | 21 | 28 | 28 | | |
| | | 28 | 37 | 44 | | |
| | | 35 | 55 | 57 | | |
| | | 42 | 60 | 78 | | |
| 674449 | 10 | 3 | 29 | 26 | GalNac$_3$-7a | A$_d$ |
| | | 7 | 32 | 31 | | |
| | | 14 | 38 | 41 | | |
| | | 21 | 44 | 44 | | |
| | | 28 | 53 | 63 | | |
| | | 35 | 69 | 77 | | |
| | | 42 | 78 | 99 | | |
| 674450 | 10 | 3 | 33 | 30 | GalNAc3-10a | A$_d$ |
| | | 7 | 35 | 34 | | |
| | | 14 | 31 | 34 | | |
| | | 21 | 44 | 44 | | |
| | | 28 | 56 | 61 | | |
| | | 35 | 68 | 70 | | |
| | | 42 | 83 | 95 | | |
| 674451 | 10 | 3 | 35 | 33 | GalNac$_3$-13a | A$_d$ |
| | | 7 | 24 | 32 | | |
| | | 14 | 40 | 34 | | |
| | | 21 | 48 | 48 | | |
| | | 28 | 54 | 67 | | |
| | | 35 | 65 | 75 | | |
| | | 42 | 74 | 97 | | |

Example 80

Antisense Inhibition In Vivo by Oligonucleotides Targeting Alpha-1 Antitrypsin (A1AT) Comprising a GalNAc$_3$ Conjugate The oligonucleotides listed in Table 72 below were tested in a study for dose-dependent inhibition of A1AT in mice.

TABLE 72

Modified ASOs targeting A1AT

| ISIS No. | Sequences (5' to 3') | GalNAc$_3$ Cluster | CM | SEQ ID No. |
|---|---|---|---|---|
| 476366 | A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | n/a | n/a | 4895 |
| 656326 | A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_{eo}$A$_{do'}$-GalNAc$_3$-1$_a$ | GalNAc$_3$-1a | A$_d$ | 4896 |
| 678381 | GalNAc$_3$-3$_{a'-o'}$A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-3a | A$_d$ | 4897 |
| 678382 | GalNAc$_3$-7$_{a'-o'}$A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-7a | A$_d$ | 4897 |
| 678383 | GalNAc$_3$-10$_{a'-o'}$A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-10a | A$_d$ | 4897 |
| 678384 | GalNAc$_3$-13$_{a'-o'}$A$_{do}$A$_{es}$$^m$C$_{es}$$^m$C$_{es}$$^m$C$_{es}$A$_{es}$A$_{ds}$T$_{ds}$T$_{ds}$$^m$C$_{ds}$A$_{ds}$G$_{ds}$A$_{ds}$A$_{ds}$G$_{ds}$G$_{ds}$A$_{es}$A$_{es}$G$_{es}$G$_{es}$A$_e$ | GalNAc$_3$-13a | A$_d$ | 4897 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, and GalNAc$_3$-13$_a$ was shown in Example 62.

Treatment

Six week old, male C57BL/6 mice (Jackson Laboratory, Bar Harbor, Me.) were each injected subcutaneously once per week at a dosage shown below, for a total of three doses, with an oligonucleotide listed in Table 72 or with PBS. Each treatment group consisted of 4 animals. The mice were sacrificed 72 hours following the final administration. A1AT liver mRNA levels were determined using real-time PCR and RIBOGREEN® RNA quantification reagent (Molecular Probes, Inc. Eugene, Oreg.) according to standard protocols. A1AT plasma protein levels were determined using the Mouse Alpha 1-Antitrypsin ELISA (catalog #41-A1AMS-E01, Alpco, Salem, N.H.). The results below are presented as the average percent of A1AT liver mRNA and plasma protein levels for each treatment group, normalized to the PBS control.

As illustrated in Table 73, treatment with antisense oligonucleotides lowered A1AT liver mRNA and A1AT plasma protein levels in a dose-dependent manner. The oligonucleotides comprising a GalNAc conjugate were significantly more potent than the parent (ISIS 476366).

TABLE 73

A1AT liver mRNA and plasma protein levels

| ISIS No. | Dosage (mg/kg) | A1AT liver mRNA (% PBS) | A1AT plasma protein (% PBS) | GalNAc$_3$ Cluster | CM |
|---|---|---|---|---|---|
| PBS | n/a | 100 | 100 | n/a | n/a |
| 476366 | 5 | 86 | 78 | n/a | n/a |
|  | 15 | 73 | 61 |  |  |
|  | 45 | 30 | 38 |  |  |
| 656326 | 0.6 | 99 | 90 | GalNAc$_3$-1a | A$_d$ |
|  | 2 | 61 | 70 |  |  |
|  | 6 | 15 | 30 |  |  |
|  | 18 | 6 | 10 |  |  |
| 678381 | 0.6 | 105 | 90 | GalNAc$_3$-3a | A$_d$ |
|  | 2 | 53 | 60 |  |  |
|  | 6 | 16 | 20 |  |  |
|  | 18 | 7 | 13 |  |  |
| 678382 | 0.6 | 90 | 79 | GalNAc$_3$-7a | A$_d$ |
|  | 2 | 49 | 57 |  |  |
|  | 6 | 21 | 27 |  |  |
|  | 18 | 8 | 11 |  |  |
| 678383 | 0.6 | 94 | 84 | GalNAc$_3$-10a | A$_d$ |
|  | 2 | 44 | 53 |  |  |
|  | 6 | 13 | 24 |  |  |
|  | 18 | 6 | 10 |  |  |
| 678384 | 0.6 | 106 | 91 | GalNAc$_3$-13a | A$_d$ |
|  | 2 | 65 | 59 |  |  |
|  | 6 | 26 | 31 |  |  |
|  | 18 | 11 | 15 |  |  |

Liver transaminase and BUN levels in plasma were measured at time of sacrifice using standard protocols. Body weights and organ weights were also measured. The results are shown in Table 74 below. Body weight is shown as % relative to baseline. Organ weights are shown as % of body weight relative to the PBS control group.

TABLE 74

| ISIS No. | Dosage (mg/kg) | ALT (U/L) | AST (U/L) | BUN (mg/dl) | Body weight (% baseline) | Liver weight (Rel % BW) | Kidney weight (Rel % BW) | Spleen weight (Rel % BW) |
|---|---|---|---|---|---|---|---|---|
| PBS | n/a | 25 | 51 | 37 | 119 | 100 | 100 | 100 |
| 476366 | 5 | 34 | 68 | 35 | 116 | 91 | 98 | 106 |
|  | 15 | 37 | 74 | 30 | 122 | 92 | 101 | 128 |
|  | 45 | 30 | 47 | 31 | 118 | 99 | 108 | 123 |
| 656326 | 0.6 | 29 | 57 | 40 | 123 | 100 | 103 | 119 |
|  | 2 | 36 | 75 | 39 | 114 | 98 | 111 | 106 |
|  | 6 | 32 | 67 | 39 | 125 | 99 | 97 | 122 |
|  | 18 | 46 | 77 | 36 | 116 | 102 | 109 | 101 |
| 678381 | 0.6 | 26 | 57 | 32 | 117 | 93 | 109 | 110 |
|  | 2 | 26 | 52 | 33 | 121 | 96 | 106 | 125 |

TABLE 74-continued

| ISIS No. | Dosage (mg/kg) | ALT (U/L) | AST (U/L) | BUN (mg/dl) | Body weight (% baseline) | Liver weight (Rel % BW) | Kidney weight (Rel % BW) | Spleen weight (Rel % BW) |
|---|---|---|---|---|---|---|---|---|
|  | 6 | 40 | 78 | 32 | 124 | 92 | 106 | 126 |
|  | 18 | 31 | 54 | 28 | 118 | 94 | 103 | 120 |
| 678382 | 0.6 | 26 | 42 | 35 | 114 | 100 | 103 | 103 |
|  | 2 | 25 | 50 | 31 | 117 | 91 | 104 | 117 |
|  | 6 | 30 | 79 | 29 | 117 | 89 | 102 | 107 |
|  | 18 | 65 | 112 | 31 | 120 | 89 | 104 | 113 |
| 678383 | 0.6 | 30 | 67 | 38 | 121 | 91 | 100 | 123 |
|  | 2 | 33 | 53 | 33 | 118 | 98 | 102 | 121 |
|  | 6 | 32 | 63 | 32 | 117 | 97 | 105 | 105 |
|  | 18 | 36 | 68 | 31 | 118 | 99 | 103 | 108 |
| 678384 | 0.6 | 36 | 63 | 31 | 118 | 98 | 103 | 98 |
|  | 2 | 32 | 61 | 32 | 119 | 93 | 102 | 114 |
|  | 6 | 34 | 69 | 34 | 122 | 100 | 100 | 96 |
|  | 18 | 28 | 54 | 30 | 117 | 98 | 101 | 104 |

Example 81

Duration of Action In Vivo of Oligonucleotides Targeting A1AT Comprising a GalNAc$_3$ Cluster The oligonucleotides listed in Table 72 were tested in a single dose study for duration of action in mice.

Treatment

Six week old, male C57BL/6 mice were each injected subcutaneously once with an oligonucleotide listed in Table 72 or with PBS. Each treatment group consisted of 4 animals. Blood was drawn the day before dosing to determine baseline and at 5, 12, 19, and 25 days following the dose. Plasma A1AT protein levels were measured via ELISA (see Example 80). The results below are presented as the average percent of plasma A1AT protein levels for each treatment group, normalized to baseline levels. The results show that the oligonucleotides comprising a GalNAc conjugate were more potent and had longer duration of action than the parent lacking a GalNAc conjugate (ISIS 476366). Furthermore, the oligonucleotides comprising a 5'-GalNAc conjugate (ISIS 678381, 678382, 678383, and 678384) were generally even more potent with even longer duration of action than the oligonucleotide comprising a 3'-GalNAc conjugate (ISIS 656326).

TABLE 75

Plasma A1AT protein levels in mice

| ISIS No. | Dosage (mg/kg) | Time point (days post-dose) | A1AT (% baseline) | GalNAc$_3$ Cluster | CM |
|---|---|---|---|---|---|
| PBS | n/a | 5 | 93 | n/a | n/a |
|  |  | 12 | 93 |  |  |
|  |  | 19 | 90 |  |  |
|  |  | 25 | 97 |  |  |
| 476366 | 100 | 5 | 38 | n/a | n/a |
|  |  | 12 | 46 |  |  |
|  |  | 19 | 62 |  |  |
|  |  | 25 | 77 |  |  |
| 656326 | 18 | 5 | 33 | GalNAc$_3$-1a | A$_d$ |
|  |  | 12 | 36 |  |  |
|  |  | 19 | 51 |  |  |
|  |  | 25 | 72 |  |  |
| 678381 | 18 | 5 | 21 | GalNAc$_3$-3a | A$_d$ |
|  |  | 12 | 21 |  |  |
|  |  | 19 | 35 |  |  |
|  |  | 25 | 48 |  |  |
| 678382 | 18 | 5 | 21 | GalNAc$_3$-7a | A$_d$ |
|  |  | 12 | 21 |  |  |
|  |  | 19 | 39 |  |  |
|  |  | 25 | 60 |  |  |
| 678383 | 18 | 5 | 24 | GalNAc$_3$-10a | A$_d$ |
|  |  | 12 | 21 |  |  |
|  |  | 19 | 45 |  |  |
|  |  | 25 | 73 |  |  |
| 678384 | 18 | 5 | 29 | GalNAc$_3$-13a | A$_d$ |
|  |  | 12 | 34 |  |  |
|  |  | 19 | 57 |  |  |
|  |  | 25 | 76 |  |  |

Example 82

Antisense Inhibition In Vitro by Oligonucleotides Targeting SRB-1 Comprising a GalNAc$_3$ Conjugate Primary mouse liver hepatocytes were seeded in 96 well plates at 15,000 cells/well 2 hours prior to treatment. The oligonucleotides listed in Table 76 were added at 2, 10, 50, or 250 nM in Williams E medium and cells were incubated overnight at 37° C. in 5% CO$_2$. Cells were lysed 16 hours following oligonucleotide addition, and total RNA was purified using RNease 3000 BioRobot (Qiagen). SRB-1 mRNA levels were determined using real-time PCR and RIBOGREEN® RNA quantification reagent (Molecular Probes, Inc. Eugene, Oreg.) according to standard protocols. IC$_{50}$ values were determined using Prism 4 software (Graph-Pad). The results show that oligonucleotides comprising a variety of different GalNAc conjugate groups and a variety of different cleavable moieties are significantly more potent in an in vitro free uptake experiment than the parent oligonucleotides lacking a GalNAc conjugate group (ISIS 353382 and 666841).

TABLE 76

Inhibition of SRB-1 expression in vitro

| ISIS No. | Sequence (5' to 3') | Linkages | GalNac Cluster | CM | IC$_{50}$ (nM) | SEQ ID No. |
|---|---|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | n/a | n/a | 250 | 4886 |
| 655861 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$'-GalNAc$_3$-1$_a$ | PS | GalNAc$_3$-1a | A$_d$ | 40 | 4887 |
| 661161 | GalNAc$_3$-3$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | A$_d$ | 40 | 4888 |
| 661162 | GalNAc$_3$-3$_a$-$_o$'A$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-3$_a$ | A$_d$ | 8 | 4888 |
| 664078 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$A$_{do}$'-GalNAc$_3$-9$_a$ | PS | GalNAc$_3$-9$_a$ | A$_d$ | 20 | 4887 |
| 665001 | GalNAc$_3$-3$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-8$_a$ | A$_d$ | 70 | 4888 |
| 666224 | GalNAc$_3$-5$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-5$_a$ | A$_d$ | 80 | 4888 |
| 666841 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | n/a | n/a | >250 | 4886 |
| 666881 | GalNA$_3$-10$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-10$_a$ | A$_d$ | 30 | 4888 |
| 666904 | GalNAc$_3$-3$_a$-$_o$'G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | PO | 9 | 4886 |
| 666924 | GalNAc$_3$-3$_a$-$_o$'T$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-3$_a$ | T$_d$ | 15 | 4891 |
| 666961 | GalNAc$_3$-6$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-6$_a$ | A$_d$ | 150 | 4888 |
| 666981 | GalNAc$_3$-7$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-7$_a$ | A$_d$ | 20 | 4888 |
| 670061 | GalNAc$_3$-13$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-13$_a$ | A$_d$ | 30 | 4888 |
| 670699 | GalNAc$_3$-3$_a$-$_o$'T$_{do}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-3$_a$ | T$_d$ | 15 | 4891 |
| 670700 | GalNAc$_3$-3$_a$-$_o$'A$_{eo}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-3$_a$ | A$_e$ | 30 | 4888 |
| 670701 | GalNAc$_3$-3$_a$-$_o$'T$_{e}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$$^m$C$_{eo}$$^m$C$_{es}$T$_{es}$T$_e$ | PO/PS | GalNAc$_3$-3$_a$ | T$_e$ | 25 | 4888 |
| 671144 | GalNAc$_3$-12$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PS | GalNAc$_3$-12$_a$ | A$_d$ | 40 | 4888 |
| 671165 | GalNAc$_3$-14$_a$-$_o$'A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | PO/PS | GalNAc$_3$-13$_a$ | A$_d$ | 8 | 4888 |

TABLE 76-continued

Inhibition of SRB-1 expression in vitro

| ISIS No. | Sequence (5' to 3') | Linkages | GalNac Cluster | CM | IC$_{50}$ (nM) | SEQ ID No. |
|---|---|---|---|---|---|---|
| 671261 | GalNAc$_3$-14$_{a'-o}$A$_{do}$G$_{es}$$^m$C$_{es}$T$_{es}$ T$_{es}$$^m$C$_{es}$A$_{ds}$G$_{ds}$T$_{ds}$$^m$C$_{ds}$A$_{ds}$T$_{ds}$ G$_{ds}$A$_{ds}$$^m$C$_{ds}$T$_{ds}$T$_{es}$$^m$C$_{es}$$^m$C$_{es}$ T$_{es}$T$_e$ | PS | GalNAc$_3$-14$_a$ | A$_d$ | >250 | 4888 |

The structure of GalNAc$_3$-1$_a$ was shown previously in Example 9, GalNAc$_3$-3$_a$ was shown in Example 39, GalNAc$_3$-5$_a$ was shown in Example 49, GalNAc$_3$-6$_a$ was shown in Example 51, GalNAc$_3$-7$_a$ was shown in Example 48, GalNAc$_3$-8$_a$ was shown in Example 47, GalNAc$_3$-9$_a$ was shown in Example 52, GalNAc$_3$-10$_a$ was shown in Example 46, GalNAc$_3$-12$_a$ was shown in Example 61, GalNAc$_3$-13$_a$ was shown in Example 62, GalNAc$_3$-14$_a$ was shown in Example 63, GalNAc$_3$-15$_a$ was shown in Example 64, GalNAc$_3$-17$_a$ was shown in Example 68, GalNAc$_3$-18$_a$ was shown in Example 69, GalNAc$_3$-19$_a$ was shown in Example 70, GalNAc$_3$-20$_a$ was shown in Example 71, and GalNAc$_3$-23$_a$ was shown in Example 76.

Example 83

Antisense Inhibition In Vivo by Oligonucleotides Targeting Factor XI Comprising a GalNAc$_3$ Cluster The oligonucleotides listed in Table 77 below were tested in a study for dose-dependent inhibition of Factor XI in mice.

NAc$_3$-7$_a$ was shown in Example 48, GalNAc$_3$-10$_a$ was shown in Example 46, and GalNAc$_3$-13$_a$ was shown in Example 62.

Treatment

Six to eight week old mice were each injected subcutaneously once per week at a dosage shown below, for a total of three doses, with an oligonucleotide listed below or with PBS. Each treatment group consisted of 4 animals. The mice were sacrificed 72 hours following the final dose. Factor XI liver mRNA levels were measured using real-time PCR and normalized to cyclophilin according to standard protocols. Liver transaminases, BUN, and bilirubin were also measured. The results below are presented as the average percent for each treatment group, normalized to the PBS control.

As illustrated in Table 78, treatment with antisense oligonucleotides lowered Factor XI liver mRNA in a dose-dependent manner. The results show that the oligonucleotides comprising a GalNAc conjugate were more potent than the parent lacking a GalNAc conjugate (ISIS 404071). Furthermore, the oligonucleotides comprising a 5'-GalNAc conjugate (ISIS 663086, 678347, 678348, and 678349) were even more potent than the oligonucleotide comprising a 3'-GalNAc conjugate (ISIS 656173).

TABLE 77

Modified oligonucleotides targeting Factor XI

| ISIS No. | Sequence (5' to 3') | GalNAc cluster | CM | SEQ ID No. |
|---|---|---|---|---|
| 404071 | T$_{es}$G$_{es}$G$_{es}$T$_{es}$A$_{es}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{es}$G$_{es}$A$_{es}$G$_{es}$G$_e$ | n/a | n/a | 4889 |
| 656173 | T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{eo}$G$_{eo}$A$_{es}$G$_{es}$G$_{eo}$A$_{do'}$-GalNAc$_3$-1$_a$ | GalNAc$_3$-1$_a$ | A$_d$ | 4890 |
| 663086 | GalNAc$_3$-3$_{a'-o}$A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{eo}$G$_{eo}$A$_{es}$G$_{es}$G$_e$ | GalNAc$_3$-3$_a$ | A$_d$ | 4898 |
| 678347 | GalNAc$_3$-7$_{a'-o}$A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{eo}$G$_{eo}$A$_{es}$G$_{es}$G$_e$ | GalNAc$_3$-7$_a$ | A$_d$ | 4898 |
| 678348 | GalNAc$_3$-10$_{a'-o}$A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{eo}$G$_{eo}$A$_{es}$G$_{es}$G$_e$ | GalNAc$_3$-10$_a$ | A$_d$ | 4898 |
| 678349 | GalNAc$_3$-13$_{a'-o}$A$_{do}$T$_{es}$G$_{eo}$G$_{eo}$T$_{eo}$A$_{eo}$A$_{ds}$T$_{ds}$$^m$C$_{ds}$$^m$C$_{ds}$A$_{ds}$$^m$C$_{ds}$T$_{ds}$T$_{ds}$T$_{ds}$$^m$C$_{ds}$A$_{eo}$G$_{eo}$A$_{es}$G$_{es}$G$_e$ | GalNAc$_3$-13$_a$ | A$_d$ | 4898 |

The structure of GalNAc$_3$-1$_a$ was shown previously in Example 9, GalNAc$_3$-3$_a$ was shown in Example 39, Gal-

TABLE 78

Factor XI liver mRNA, liver transaminase, BUN, and bilirubin levels

| ISIS No. | Dosage (mg/kg) | Factor XI mRNA (% PBS) | ALT (U/L) | AST (U/L) | BUN (mg/dL) | Bilirubin (mg/dL) | GalNac$_3$ Cluster | SEQ ID No. |
|---|---|---|---|---|---|---|---|---|
| PBS | n/a | 100 | 63 | 70 | 21 | 0.18 | n/a | n/a |
| 404071 | 3 | 65 | 41 | 58 | 21 | 0.15 | n/a | 4889 |
|  | 10 | 33 | 49 | 53 | 23 | 0.15 |  |  |
|  | 30 | 17 | 43 | 57 | 22 | 0.14 |  |  |
| 656173 | 0.7 | 43 | 90 | 89 | 21 | 0.16 | GalNac$_3$-1a | 4890 |
|  | 2 | 9 | 36 | 58 | 26 | 0.17 |  |  |
|  | 6 | 3 | 50 | 63 | 25 | 0.15 |  |  |

TABLE 78-continued

Factor XI liver mRNA, liver transaminase, BUN, and bilirubin levels

| ISIS No. | Dosage (mg/kg) | Factor XI mRNA (% PBS) | ALT (U/L) | AST (U/L) | BUN (mg/dL) | Bilirubin (mg/dL) | GalNac3 Cluster | SEQ ID No. |
|---|---|---|---|---|---|---|---|---|
| 663086 | 0.7 | 33 | 91 | 169 | 25 | 0.16 | GalNac$_3$-3a | 4898 |
|  | 2 | 7 | 38 | 55 | 21 | 0.16 |  |  |
|  | 6 | 1 | 34 | 40 | 23 | 0.14 |  |  |
| 678347 | 0.7 | 35 | 28 | 49 | 20 | 0.14 | GalNac$_3$-7a | 4898 |
|  | 2 | 10 | 180 | 149 | 21 | 0.18 |  |  |
|  | 6 | 1 | 44 | 76 | 19 | 0.15 |  |  |
| 678348 | 0.7 | 39 | 43 | 54 | 21 | 0.16 | GalNac$_3$-10a | 4898 |
|  | 2 | 5 | 38 | 55 | 22 | 0.17 |  |  |
|  | 6 | 2 | 25 | 38 | 20 | 0.14 |  |  |
| 678349 | 0.7 | 34 | 39 | 46 | 20 | 0.16 | GalNac$_3$-13a | 4898 |
|  | 2 | 8 | 43 | 63 | 21 | 0.14 |  |  |
|  | 6 | 2 | 28 | 41 | 20 | 0.14 |  |  |

Example 84

Duration of Action In Vivo of Oligonucleotides Targeting Factor XI Comprising a GalNAc$_3$ Conjugate The oligonucleotides listed in Table 77 were tested in a single dose study for duration of action in mice.

Treatment

Six to eight week old mice were each injected subcutaneously once with an oligonucleotide listed in Table 77 or with PBS. Each treatment group consisted of 4 animals. Blood was drawn by tail bleeds the day before dosing to determine baseline and at 3, 10, and 17 days following the dose. Plasma Factor XI protein levels were measured by ELISA using Factor XI capture and biotinylated detection antibodies from R & D Systems, Minneapolis, Minn. (catalog # AF2460 and # BAF2460, respectively) and the OptEIA Reagent Set B (Catalog #550534, BD Biosciences, San Jose, Calif.). The results below are presented as the average percent of plasma Factor XI protein levels for each treatment group, normalized to baseline levels. The results show that the oligonucleotides comprising a GalNAc conjugate were more potent with longer duration of action than the parent lacking a GalNAc conjugate (ISIS 404071). Furthermore, the oligonucleotides comprising a 5'-GalNAc conjugate (ISIS 663086, 678347, 678348, and 678349) were even more potent with an even longer duration of action than the oligonucleotide comprising a 3'-GalNAc conjugate (ISIS 656173).

TABLE 79

Plasma Factor XI protein levels in mice

| ISIS No. | Dosage (mg/kg) | Time point post-dose | (days Factor XI (% baseline) | GalNAc3 Cluster | CM | SEQ ID No. |
|---|---|---|---|---|---|---|
| PBS | n/a | 3 | 123 | n/a | n/a | n/a |
|  |  | 10 | 56 |  |  |  |
|  |  | 17 | 100 |  |  |  |
| 404071 | 30 | 3 | 11 | n/a | n/a | 4889 |
|  |  | 10 | 47 |  |  |  |
|  |  | 17 | 52 |  |  |  |
| 656173 | 6 | 3 | 1 | GalNac$_3$-1a | A$_d$ | 4890 |
|  |  | 10 | 3 |  |  |  |
|  |  | 17 | 21 |  |  |  |
| 663086 | 6 | 3 | 1 | GalNac$_3$-3a | A$_d$ | 4898 |
|  |  | 10 | 2 |  |  |  |
|  |  | 17 | 9 |  |  |  |

TABLE 79-continued

Plasma Factor XI protein levels in mice

| ISIS No. | Dosage (mg/kg) | Time point post-dose | (days Factor XI (% baseline) | GalNAc3 Cluster | CM | SEQ ID No. |
|---|---|---|---|---|---|---|
| 678347 | 6 | 3 | 1 | GalNac$_3$-7a | A$_d$ | 4898 |
|  |  | 10 | 1 |  |  |  |
|  |  | 17 | 8 |  |  |  |
| 678348 | 6 | 3 | 1 | GalNac$_3$-10a | A$_d$ | 4898 |
|  |  | 10 | 1 |  |  |  |
|  |  | 17 | 6 |  |  |  |
| 678349 | 6 | 3 | 1 | GalNac$_3$-13a | A$_d$ | 4898 |
|  |  | 10 | 1 |  |  |  |
|  |  | 17 | 5 |  |  |  |

Example 85

Antisense Inhibition In Vivo by Oligonucleotides Targeting SRB-1 Comprising a GalNAc$_3$ Conjugate Oligonucleotides listed in Table 76 were tested in a dose-dependent study for antisense inhibition of SRB-1 in mice.

Treatment

Six to eight week old C57BL/6 mice were each injected subcutaneously once per week at a dosage shown below, for a total of three doses, with an oligonucleotide listed in Table 76 or with saline. Each treatment group consisted of 4 animals. The mice were sacrificed 48 hours following the final administration to determine the SRB-1 mRNA levels using real-time PCR and RIBOGREEN® RNA quantification reagent (Molecular Probes, Inc. Eugene, Oreg.) according to standard protocols. The results below are presented as the average percent of liver SRB-1 mRNA levels for each treatment group, normalized to the saline control.

As illustrated in Tables 80 and 81, treatment with antisense oligonucleotides lowered SRB-1 mRNA levels in a dose-dependent manner

TABLE 80

SRB-1 mRNA in liver

| ISIS No. | Dosage (mg/kg) | SRB-1 mRNA (% Saline) | GalNAc₃ Cluster | CM |
|---|---|---|---|---|
| Saline | n/a | 100 | n/a | n/a |
| 655861 | 0.1 | 94 | GalNAc₃-1a | $A_d$ |
|  | 0.3 | 119 |  |  |
|  | 1 | 68 |  |  |
|  | 3 | 32 |  |  |
| 661161 | 0.1 | 120 | GalNAc₃-3a | $A_d$ |
|  | 0.3 | 107 |  |  |
|  | 1 | 68 |  |  |
|  | 3 | 26 |  |  |
| 666881 | 0.1 | 107 | GalNAc₃-10a | $A_d$ |
|  | 0.3 | 107 |  |  |
|  | 1 | 69 |  |  |
|  | 3 | 27 |  |  |
| 666981 | 0.1 | 120 | GalNAc₃-7a | $A_d$ |
|  | 0.3 | 103 |  |  |
|  | 1 | 54 |  |  |
|  | 3 | 21 |  |  |
| 670061 | 0.1 | 118 | GalNAc₃-13a | $A_d$ |
|  | 0.3 | 89 |  |  |
|  | 1 | 52 |  |  |
|  | 3 | 18 |  |  |
| 677842 | 0.1 | 119 | GalNAc₃-20a | $A_d$ |
|  | 0.3 | 96 |  |  |
|  | 1 | 65 |  |  |
|  | 3 | 23 |  |  |

TABLE 81

SRB-1 mRNA in liver

| ISIS No. | Dosage (mg/kg) | SRB-1 mRNA (% Saline) | GalNAc₃ Cluster | CM |
|---|---|---|---|---|
| 661161 | 0.1 | 107 | GalNAc₃-3a | $A_d$ |
|  | 0.3 | 95 |  |  |
|  | 1 | 3 |  |  |
|  | 3 | 18 |  |  |
| 677841 | 0.1 | 110 | GalNAc₃-19a | $A_d$ |
|  | 0.3 | 88 |  |  |
|  | 1 | 52 |  |  |
|  | 3 | 25 |  |  |

Liver transaminase levels, total bilirubin, BUN, and body weights were also measured using standard protocols. Average values for each treatment group are shown in Table 82 below.

TABLE 82

| ISIS No. | Dosage (mg/kg) | ALT (U/L) | AST (U/L) | Bilirubin (mg/dL) | BUN (mg/dL) | Body Weight (% baseline) | GalNAc3 Cluster | CM |
|---|---|---|---|---|---|---|---|---|
| Saline | n/a | 19 | 39 | 0.17 | 26 | 118 | n/a | n/a |
| 655861 | 0.1 | 25 | 47 | 0.17 | 27 | 114 | GalNac₃-1a | $A_d$ |
|  | 0.3 | 29 | 56 | 0.15 | 27 | 118 |  |  |
|  | 1 | 20 | 32 | 0.14 | 24 | 112 |  |  |
|  | 3 | 27 | 54 | 0.14 | 24 | 115 |  |  |
| 661161 | 0.1 | 35 | 83 | 0.13 | 24 | 113 | GalNac₃-3a | $A_d$ |
|  | 0.3 | 42 | 61 | 0.15 | 23 | 117 |  |  |
|  | 1 | 34 | 60 | 0.18 | 22 | 116 |  |  |
|  | 3 | 29 | 52 | 0.13 | 25 | 117 |  |  |
| 666881 | 0.1 | 30 | 51 | 0.15 | 23 | 118 | GalNac₃-10a | $A_d$ |
|  | 0.3 | 49 | 82 | 0.16 | 25 | 119 |  |  |
|  | 1 | 23 | 45 | 0.14 | 24 | 117 |  |  |
|  | 3 | 20 | 38 | 0.15 | 21 | 112 |  |  |
| 666981 | 0.1 | 21 | 41 | 0.14 | 22 | 113 | GalNac₃-7a | $A_d$ |
|  | 0.3 | 29 | 49 | 0.16 | 24 | 112 |  |  |
|  | 1 | 19 | 34 | 0.15 | 22 | 111 |  |  |
|  | 3 | 77 | 78 | 0.18 | 25 | 115 |  |  |
| 670061 | 0.1 | 20 | 63 | 0.18 | 24 | 111 | GalNac₃-13a | $A_d$ |
|  | 0.3 | 20 | 57 | 0.15 | 21 | 115 |  |  |
|  | 1 | 20 | 35 | 0.14 | 20 | 115 |  |  |
|  | 3 | 27 | 42 | 0.12 | 20 | 116 |  |  |
| 677842 | 0.1 | 20 | 38 | 0.17 | 24 | 114 | GalNac₃-20a | $A_d$ |
|  | 0.3 | 31 | 46 | 0.17 | 21 | 117 |  |  |
|  | 1 | 22 | 34 | 0.15 | 21 | 119 |  |  |
|  | 3 | 41 | 57 | 0.14 | 23 | 118 |  |  |

Example 86

Antisense Inhibition In Vivo by Oligonucleotides Targeting TTR Comprising a GalNAc$_3$ Cluster Oligonucleotides listed in Table 83 below were tested in a dose-dependent study for antisense inhibition of human transthyretin (TTR) in transgenic mice that express the human TTR gene.

Tables 84 and 85, treatment with antisense oligonucleotides lowered TTR expression levels in a dose-dependent manner. The oligonucleotides comprising a GalNAc conjugate were more potent than the parent lacking a GalNAc conjugate (ISIS 420915). Furthermore, the oligonucleotides comprising a GalNAc conjugate and mixed PS/PO internucleoside linkages were even more potent than the oligonucleotide comprising a GalNAc conjugate and full PS linkages.

TABLE 83

Oligonucleotides targeting human TTR

| Isis No. | Sequence 5' to 3' | Linkages | GalNAc cluster | CM | SEQ ID No. |
|---|---|---|---|---|---|
| 420915 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | PS | n/a | n/a | 4899 |
| 660261 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_{eo}$A$_{do}$,-GalNAc$_3$-1$_a$ | PS | GalNAc$_3$-1a | A$_d$ | 4900 |
| 682883 | GalNAc$_3$-3$_{a-o'}$T$_{es}$$^m$C$_{eo}$T$_{eo}$T$_{eo}$G$_{eo}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PS/PO | GalNAc$_3$-3a | PO | 4899 |
| 682884 | GalNAc$_3$-7$_{a-o'}$T$_{es}$$^m$C$_{eo}$T$_{eo}$T$_{eo}$G$_{eo}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PS/PO | GalNAc$_3$-7a | PO | 4899 |
| 682885 | GalNAc$_3$-10$_{a-o'}$T$_{es}$$^m$C$_{eo}$T$_{eo}$T$_{eo}$G$_{eo}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PS/PO | GalNAc$_3$-10a | PO | 4899 |
| 682886 | GalNAc$_3$-13$_{a-o'}$T$_{es}$$^m$C$_{eo}$T$_{eo}$T$_{eo}$G$_{eo}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_e$ | PS/PO | GalNAc$_3$-13a | PO | 4899 |
| 684057 | T$_{es}$$^m$C$_{eo}$T$_{eo}$T$_{eo}$G$_{eo}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_{eo}$A$_{do}$,-GalNAc$_3$-19$_a$ | PS/PO | GalNAc$_3$-19a | A$_d$ | 4900 |

Treatment

Eight week old TTR transgenic mice were each injected subcutaneously once per week for three weeks, for a total of three doses, with an oligonucleotide and dosage listed in the tables below or with PBS. Each treatment group consisted of 4 animals. The mice were sacrificed 72 hours following the final administration. Tail bleeds were performed at various time points throughout the experiment, and plasma TTR protein, ALT, and AST levels were measured and reported in Tables 85-87. After the animals were sacrificed, plasma ALT, AST, and human TTR levels were measured, as were body weights, organ weights, and liver human TTR mRNA levels. TTR protein levels were measured using a clinical analyzer (AU480, Beckman Coulter, Calif.). Real-time PCR and RIBOGREEN® RNA quantification reagent (Molecular Probes, Inc. Eugene, Oreg.) were used according to standard protocols to determine liver human TTR mRNA levels. The results presented in Tables 84-87 are the average values for each treatment group. The mRNA levels are the average values relative to the average for the PBS group. Plasma protein levels are the average values relative to the average value for the PBS group at baseline. Body weights are the average percent weight change from baseline until sacrifice for each individual treatment group. Organ weights shown are normalized to the animal's body weight, and the average normalized organ weight for each treatment group is then presented relative to the average normalized organ weight for the PBS group.

In Tables 84-87, "BL" indicates baseline, measurements that were taken just prior to the first dose. As illustrated in Tables 84 and 85, treatment with antisense oligonucleotides lowered TTR expression levels in a dose-dependent manner.

The legend for Table 85 can be found in Example 74. The structure of GalNAc$_3$-1 was shown in Example 9. The structure of GalNAc$_3$-3$_a$ was shown in Example 39. The structure of GalNAc$_3$-7$_a$ was shown in Example 48. The structure of GalNAc$_3$-10$_a$ was shown in Example 46. The structure of GalNAc$_3$-13$_a$ was shown in Example 62. The structure of GalNAc$_3$-19$_a$ was shown in Example 70.

TABLE 84

Antisense inhibition of human TTR in vivo

| Isis No. | Dosage (mg/kg) | TTR mRNA (% PBS) | Plasma TTR protein (% PBS) | GalNAc cluster | CM | SEQ ID No. |
|---|---|---|---|---|---|---|
| PBS | n/a | 100 | 100 | n/a | n/a | |
| 420915 | 6 | 99 | 95 | n/a | n/a | 4899 |
|  | 20 | 48 | 65 | | | |
|  | 60 | 18 | 28 | | | |
| 660261 | 0.6 | 113 | 87 | GalNAc$_3$-1a | A$_d$ | 4900 |
|  | 2 | 40 | 56 | | | |
|  | 6 | 20 | 27 | | | |
|  | 20 | 9 | 11 | | | |

TABLE 85

Antisense inhibition of human TTR in vivo

| Isis No. | Dosage (mg/kg) | TTR mRNA (% PBS) | Plasma TTR protein (% PBS at BL) | | | | GalNAc cluster | CM | SEQ ID No. |
|---|---|---|---|---|---|---|---|---|---|
| | | | BL | Day 3 | Day 10 | Day 17 (After sac) | | | |
| PBS | n/a | 100 | 100 | 96 | 90 | 114 | n/a | n/a | |
| 420915 | 6 | 74 | 106 | 86 | 76 | 83 | n/a | n/a | 4899 |
| | 20 | 43 | 102 | 66 | 61 | 58 | | | |
| | 60 | 24 | 92 | 43 | 29 | 32 | | | |
| 682883 | 0.6 | 60 | 88 | 73 | 63 | 68 | GalNAc$_3$-3a | PO | 4899 |
| | 2 | 18 | 75 | 38 | 23 | 23 | | | |
| | 6 | 10 | 80 | 35 | 11 | 9 | | | |
| 682884 | 0.6 | 56 | 88 | 78 | 63 | 67 | GalNAc$_3$-7a | PO | 4899 |
| | 2 | 19 | 76 | 44 | 25 | 23 | | | |
| | 6 | 15 | 82 | 35 | 21 | 24 | | | |
| 682885 | 0.6 | 60 | 92 | 77 | 68 | 76 | GalNAc$_3$-10a | PO | 4899 |
| | 2 | 22 | 93 | 58 | 32 | 32 | | | |
| | 6 | 17 | 85 | 37 | 25 | 20 | | | |
| 682886 | 0.6 | 57 | 91 | 70 | 64 | 69 | GalNAc$_3$-13a | PO | 4899 |
| | 2 | 21 | 89 | 50 | 31 | 30 | | | |
| | 6 | 18 | 102 | 41 | 24 | 27 | | | |
| 684057 | 0.6 | 53 | 80 | 69 | 56 | 62 | GalNAc$_3$-19a | A$_d$ | 4900 |
| | 2 | 21 | 92 | 55 | 34 | 30 | | | |
| | 6 | 11 | 82 | 50 | 18 | 13 | | | |

TABLE 86

Transaminase levels, body weight changes, and relative organ weights

| Isis No. | Dosage (mg/kg) | ALT (U/L) | | | | AST (U/L) | | | | Body (% BL) | Liver (% PBS) | Spleen (% PBS) | Kidney (% PBS) | SEQ ID No. |
|---|---|---|---|---|---|---|---|---|---|---|---|---|---|---|
| | | BL | Day 3 | Day 10 | Day 17 | BL | Day 3 | Day 10 | Day 17 | | | | | |
| PBS | n/a | 33 | 34 | 33 | 24 | 58 | 62 | 67 | 52 | 105 | 100 | 100 | 100 | n/a |
| 420915 | 6 | 34 | 33 | 27 | 21 | 64 | 59 | 73 | 47 | 115 | 99 | 89 | 91 | 4899 |
| | 20 | 34 | 30 | 28 | 19 | 64 | 54 | 56 | 42 | 111 | 97 | 83 | 89 | |
| | 60 | 34 | 35 | 31 | 24 | 61 | 58 | 71 | 58 | 113 | 102 | 98 | 95 | |
| 660261 | 0.6 | 33 | 38 | 28 | 26 | 70 | 71 | 63 | 59 | 111 | 96 | 99 | 92 | 4900 |
| | 2 | 29 | 32 | 31 | 34 | 61 | 60 | 68 | 61 | 118 | 100 | 92 | 90 | |
| | 6 | 29 | 29 | 28 | 34 | 58 | 59 | 70 | 90 | 114 | 99 | 97 | 95 | |
| | 20 | 33 | 32 | 28 | 33 | 64 | 54 | 68 | 95 | 114 | 101 | 106 | 92 | |

TABLE 87

Transaminase levels, body weight changes, and relative organ weights

| Isis No. | Dosage (mg/kg) | ALT (U/L) | | | | AST (U/L) | | | | Body (% BL) | Liver (% PBS) | Spleen (% PBS) | Kidney (% PBS) | SEQ ID No. |
|---|---|---|---|---|---|---|---|---|---|---|---|---|---|---|
| | | BL | Day 3 | Day 10 | Day 17 | BL | Day 3 | Day 10 | Day 17 | | | | | |
| PBS | n/a | 32 | 34 | 37 | 41 | 62 | 78 | 76 | 77 | 104 | 100 | 100 | 100 | n/a |
| 420915 | 6 | 32 | 30 | 34 | 34 | 61 | 71 | 72 | 66 | 102 | 103 | 102 | 105 | 4899 |
| | 20 | 41 | 34 | 37 | 33 | 80 | 76 | 63 | 54 | 106 | 107 | 135 | 101 | |
| | 60 | 36 | 30 | 32 | 34 | 58 | 81 | 57 | 60 | 106 | 105 | 104 | 99 | |
| 682883 | 0.6 | 32 | 35 | 38 | 40 | 53 | 81 | 74 | 76 | 104 | 101 | 112 | 95 | 4899 |
| | 2 | 38 | 39 | 42 | 43 | 71 | 84 | 70 | 77 | 107 | 98 | 116 | 99 | |
| | 6 | 35 | 35 | 41 | 38 | 62 | 79 | 103 | 65 | 105 | 103 | 143 | 97 | |
| 682884 | 0.6 | 33 | 32 | 35 | 34 | 70 | 74 | 75 | 67 | 101 | 100 | 130 | 99 | 4899 |
| | 2 | 31 | 32 | 38 | 38 | 63 | 77 | 66 | 55 | 104 | 103 | 122 | 100 | |
| | 6 | 38 | 32 | 36 | 34 | 65 | 85 | 80 | 62 | 99 | 105 | 129 | 95 | |
| 682885 | 0.6 | 39 | 26 | 37 | 35 | 63 | 63 | 77 | 59 | 100 | 109 | 109 | 112 | 4899 |
| | 2 | 30 | 26 | 38 | 40 | 54 | 56 | 71 | 72 | 102 | 98 | 111 | 102 | |
| | 6 | 27 | 27 | 34 | 35 | 46 | 52 | 56 | 64 | 102 | 98 | 113 | 96 | |
| 682886 | 0.6 | 30 | 40 | 34 | 36 | 58 | 87 | 54 | 61 | 104 | 99 | 120 | 101 | 4899 |
| | 2 | 27 | 26 | 34 | 36 | 51 | 55 | 55 | 69 | 103 | 91 | 105 | 92 | |
| | 6 | 40 | 28 | 34 | 37 | 107 | 54 | 61 | 69 | 109 | 100 | 102 | 99 | |
| 684057 | 0.6 | 35 | 26 | 33 | 39 | 56 | 51 | 51 | 69 | 104 | 99 | 110 | 102 | 4900 |
| | 2 | 33 | 32 | 31 | 40 | 54 | 57 | 56 | 87 | 103 | 100 | 112 | 97 | |
| | 6 | 39 | 33 | 35 | 40 | 67 | 52 | 55 | 92 | 98 | 104 | 121 | 108 | |

Example 87

Duration of Action In Vivo by Single Closes of Oligonucleotides Targeting TTR Comprising a GalNAc₃ Cluster ISIS numbers 420915 and 660261 (see Table 83) were tested in a single dose study for duration of action in mice. ISIS numbers 420915, 682883, and 682885 (see Table 83) were also tested in a single dose study for duration of action in mice.

Treatment

Eight week old, male transgenic mice that express human TTR were each injected subcutaneously once with 100 mg/kg ISIS No. 420915 or 13.5 mg/kg ISIS No. 660261. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 88

Plasma TTR protein levels

| ISIS No. | Dosage (mg/kg) | Time point (days post-dose) | TTR (% baseline) | GalNAc₃ Cluster | CM | SEQ ID No. |
|---|---|---|---|---|---|---|
| 420915 | 100 | 3 | 30 | n/a | n/a | 4899 |
|  |  | 7 | 23 |  |  |  |
|  |  | 10 | 35 |  |  |  |
|  |  | 17 | 53 |  |  |  |
|  |  | 24 | 75 |  |  |  |
|  |  | 39 | 100 |  |  |  |
| 660261 | 13.5 | 3 | 27 | GalNAc₃-1a | $A_d$ | 4900 |
|  |  | 7 | 21 |  |  |  |
|  |  | 10 | 22 |  |  |  |
|  |  | 17 | 36 |  |  |  |
|  |  | 24 | 48 |  |  |  |
|  |  | 39 | 69 |  |  |  |

Treatment

Female transgenic mice that express human TTR were each injected subcutaneously once with 100 mg/kg ISIS No. 420915, 10.0 mg/kg ISIS No. 682883, or 10.0 mg/kg 682885. Each treatment group consisted of 4 animals. Tail bleeds were performed before dosing to determine baseline and at days 3, 7, 10, 17, 24, and 39 following the dose. Plasma TTR protein levels were measured as described in Example 86. The results below are presented as the average percent of plasma TTR levels for each treatment group, normalized to baseline levels.

TABLE 89

Plasma TTR protein levels

| ISIS No. | Dosage (mg/kg) | Time point (days post-dose) | TTR (% baseline) | GalNAc₃ Cluster | CM | SEQ ID No. |
|---|---|---|---|---|---|---|
| 420915 | 100 | 3 | 48 | n/a | n/a | 4899 |
|  |  | 7 | 48 |  |  |  |
|  |  | 10 | 48 |  |  |  |
|  |  | 17 | 66 |  |  |  |
|  |  | 31 | 80 |  |  |  |
| 682883 | 10.0 | 3 | 45 | GalNAc₃-3a | PO | 4899 |
|  |  | 7 | 37 |  |  |  |
|  |  | 10 | 38 |  |  |  |
|  |  | 17 | 42 |  |  |  |
|  |  | 31 | 65 |  |  |  |
| 682885 | 10.0 | 3 | 40 | GalNAc₃-10a | PO | 4899 |
|  |  | 7 | 33 |  |  |  |
|  |  | 10 | 34 |  |  |  |
|  |  | 17 | 40 |  |  |  |
|  |  | 31 | 64 |  |  |  |

The results in Tables 88 and 89 show that the oligonucleotides comprising a GalNAc conjugate are more potent with a longer duration of action than the parent oligonucleotide lacking a conjugate (ISIS 420915).

Example 88

Splicing Modulation In Vivo by Oligonucleotides Targeting SMN Comprising a GalNAc₃ Conjugate The oligonucleotides listed in Table 90 were tested for splicing modulation of human survival of motor neuron (SMN) in mice.

TABLE 90

Modified ASOs targeting SMN

| ISIS No. | Sequences (5' to 3') | GalNAc₃ Cluster | CM | SEQ ID No. |
|---|---|---|---|---|
| 387954 | $A_{es}T_{es}T_{es}{}^mC_{es}A_{es}{}^mC_{es}T_{es}T_{es}T_{es}{}^mC_{es}A_{es}T_{es}A_{es}A_{es}T_{es}G_{es}{}^mC_{es}T_{es}G_{es}G_{e}$ | n/a | n/a | 4901 |
| 699819 | GalNAc₃-7$_{a\text{-}o}$$A_{es}T_{es}T_{es}{}^mC_{es}A_{es}{}^mC_{es}T_{es}T_{es}T_{es}{}^mC_{es}A_{es}T_{es}A_{es}A_{es}T_{es}G_{es}{}^mC_{es}T_{es}G_{es}G_{e}$ | GalNAc₃-7a | PO | 4901 |
| 699821 | GalNAc₃-7$_{a\text{-}o}$$A_{es}T_{eo}T_{eo}{}^mC_{eo}A_{eo}{}^mC_{eo}T_{eo}T_{eo}T_{eo}{}^mC_{eo}A_{eo}T_{eo}A_{eo}A_{eo}T_{eo}G_{eo}{}^mC_{eo}T_{es}G_{es}G_{e}$ | GalNAc₃-7a | PO | 4901 |
| 700000 | $A_{es}T_{es}T_{es}{}^mC_{es}A_{es}{}^mC_{es}T_{es}T_{es}T_{es}{}^mC_{es}A_{es}T_{es}A_{es}A_{es}T_{es}G_{es}{}^mC_{es}T_{es}G_{es}G_{eo}A_{do}$-GalNAc₃-1$_a$ | GalNAc₃-1a | $A_d$ | 4902 |
| 703421 | X-ATT${}^m$CA${}^m$CTTT${}^m$CATAATG${}^m$CTGG | n/a | n/a | 4901 |
| 703422 | GalNAc₃-7$_b$-X-ATT${}^m$CA${}^m$CTTT${}^m$CATAATG${}^m$CTGG | GalNAc₃-7b | n/a | 4901 |

The structure of GalNAc₃-7$_a$ was shown previously in Example 48. "X" indicates a 5' primary amine generated by Gene Tools (Philomath, Oreg.), and GalNAc₃-7$_b$ indicates the structure of GalNAc₃-7$_a$ lacking the —NH—C₆—O portion of the linker as shown below:

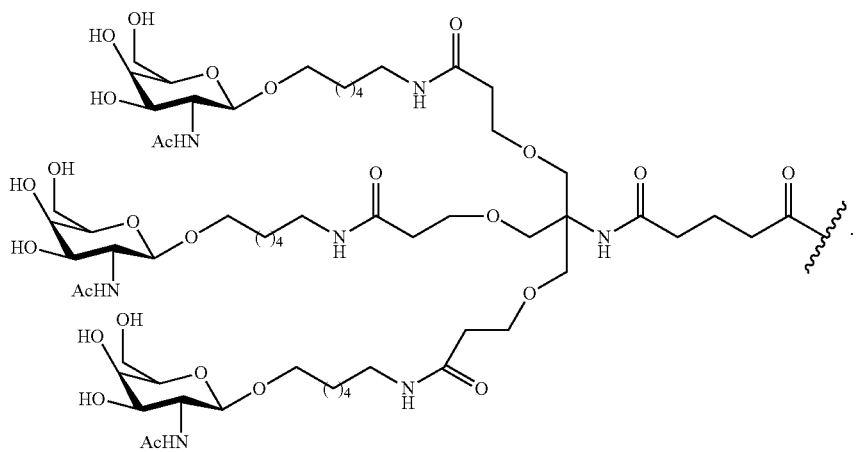

ISIS numbers 703421 and 703422 are morphlino oligonucleotides, wherein each nucleotide of the two oligonucleotides is a morpholino nucleotide.

Treatment

Six week old transgenic mice that express human SMN were injected subcutaneously once with an oligonucleotide listed in Table 91 or with saline. Each treatment group consisted of 2 males and 2 females. The mice were sacrificed 3 days following the dose to determine the liver human SMN mRNA levels both with and without exon 7 using real-time PCR according to standard protocols. Total RNA was measured using Ribogreen reagent. The SMN mRNA levels were normalized to total mRNA, and further normalized to the averages for the saline treatment group. The resulting average ratios of SMN mRNA including exon 7 to SMN mRNA missing exon 7 are shown in Table 91. The results show that fully modified oligonucleotides that modulate splicing and comprise a GalNAc conjugate are significantly more potent in altering splicing in the liver than the parent oligonucleotides lacking a GlaNAc conjugate. Furthermore, this trend is maintained for multiple modification chemistries, including 2'-MOE and morpholino modified oligonucleotides.

TABLE 91

Effect of oligonucleotides targeting human SMN in vivo

| ISIS No. | Dose (mg/kg) | +Exon 7/−Exon 7 | GalNAc$_3$ Cluster | CM | SEQ ID No. |
|---|---|---|---|---|---|
| Saline | n/a | 1.00 | n/a | n/a | n/a |
| 387954 | 32 | 1.65 | n/a | n/a | 4901 |
| 387954 | 288 | 5.00 | n/a | n/a | 4901 |
| 699819 | 32 | 7.84 | GalNAc$_3$-7a | PO | 4901 |
| 699821 | 32 | 7.22 | GalNAc$_3$-7a | PO | 4901 |

TABLE 91-continued

Effect of oligonucleotides targeting human SMN in vivo

| ISIS No. | Dose (mg/kg) | +Exon 7/−Exon 7 | GalNAc$_3$ Cluster | CM | SEQ ID No. |
|---|---|---|---|---|---|
| 700000 | 32 | 6.91 | GalNAc$_3$-1a | A$_d$ | 4902 |
| 703421 | 32 | 1.27 | n/a | n/a | 4901 |
| 703422 | 32 | 4.12 | GalNAc$_3$-7b | n/a | 4901 |

Example 89

Antisense Inhibition In Vivo by Oligonucleotides Targeting Apolipoprotein A (Apo(a)) Comprising a GalNAc$_3$ Conjugate The oligonucleotides listed in Table 92 below were tested in a study for dose-dependent inhibition of Apo(a) in transgenic mice.

TABLE 92

Modified ASOs targeting Apo(a)

| ISIS No. | Sequences (5' to 3') | GalNAc$_3$ Cluster | CM | SEQ ID No. |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | n/a | n/a | 4903 |
| 681257 | GalNAc$_3$-7$_{a\text{-}o}$T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_e$ | GalNAc$_3$-7a | PO | 4903 |

The structure of GalNAc$_3$-7$_a$ was shown in Example 48.

Treatment

Eight week old, female C57BL/6 mice (Jackson Laboratory, Bar Harbor, Me.) were each injected subcutaneously once per week at a dosage shown below, for a total of six doses, with an oligonucleotide listed in Table 92 or with PBS. Each treatment group consisted of 3-4 animals. Tail bleeds were performed the day before the first dose and weekly following each dose to determine plasma Apo(a) protein levels. The mice were sacrificed two days following the final administration. Apo(a) liver mRNA levels were determined using real-time PCR and RIBOGREEN® RNA quantification reagent (Molecular Probes, Inc. Eugene, Oreg.) according to standard protocols. Apo(a) plasma protein levels were determined using ELISA, and liver transaminase levels were determined. The mRNA and plasma protein results in Table 93 are presented as the treatment group average percent relative to the PBS treated group. Plasma protein levels were further normalized to the baseline (BL) value for the PBS group. Average absolute transaminase levels and body weights (% relative to baseline averages) are reported in Table 94.

As illustrated in Table 93, treatment with the oligonucleotides lowered Apo(a) liver mRNA and plasma protein levels in a dose-dependent manner. Furthermore, the oligonucleotide comprising the GalNAc conjugate was significantly more potent with a longer duration of action than the parent oligonucleotide lacking a GalNAc conjugate. As illustrated in Table 94, transaminase levels and body weights were unaffected by the oligonucleotides, indicating that the oligonucleotides were well tolerated.

mRNA levels are the average values relative to the average for the PBS group. Plasma protein levels are the average values relative to the average value for the PBS group at baseline. "BL" indicates baseline, measurements that were taken just prior to the first dose. As illustrated in Table 96, treatment with antisense oligonucleotides lowered TTR expression levels in a dose-dependent manner. The oligonucleotides comprising a GalNAc conjugate were more potent than the parent lacking a GalNAc conjugate (ISIS 420915), and oligonucleotides comprising a phosphodiester or deoxyadenosine cleavable moiety showed significant improvements in potency compared to the parent lacking a conjugate (see ISIS numbers 682883 and 666943 vs 420915 and see Examples 86 and 87).

TABLE 93

Apo(a) liver mRNA and plasma protein levels

| ISIS No. | Dosage (mg/kg) | Apo(a) mRNA (% PBS) | Apo(a) plasma protein (% PBS) | | | | | |
|---|---|---|---|---|---|---|---|---|
| | | | BL | Week 1 | Week 2 | Week 3 | Week 4 | Week 5 | Week 6 |
| PBS | n/a | 100 | 100 | 120 | 119 | 113 | 88 | 121 | 97 |
| 494372 | 3 | 80 | 84 | 89 | 91 | 98 | 87 | 87 | 79 |
| | 10 | 30 | 87 | 72 | 76 | 71 | 57 | 59 | 46 |
| | 30 | 5 | 92 | 54 | 28 | 10 | 7 | 9 | 7 |
| 681257 | 0.3 | 75 | 79 | 76 | 89 | 98 | 71 | 94 | 78 |
| | 1 | 19 | 79 | 88 | 66 | 60 | 54 | 32 | 24 |
| | 3 | 2 | 82 | 52 | 17 | 7 | 4 | 6 | 5 |
| | 10 | 2 | 79 | 17 | 6 | 3 | 2 | 4 | 5 |

TABLE 94

| ISIS No. | Dosage (mg/kg) | ALT (U/L) | AST (U/L) | Body weight (% baseline) |
|---|---|---|---|---|
| PBS | n/a | 37 | 54 | 103 |
| 494372 | 3 | 28 | 68 | 106 |
| | 10 | 22 | 55 | 102 |
| | 30 | 19 | 48 | 103 |
| 681257 | 0.3 | 30 | 80 | 104 |
| | 1 | 26 | 47 | 105 |
| | 3 | 29 | 62 | 102 |
| | 10 | 21 | 52 | 107 |

Example 90

Antisense Inhibition In Vivo by Oligonucleotides Targeting TTR Comprising a GalNAc$_3$ Cluster Oligonucleotides listed in Table 95 below were tested in a dose-dependent study for antisense inhibition of human transthyretin (TTR) in transgenic mice that express the human TTR gene.

Treatment

TTR transgenic mice were each injected subcutaneously once per week for three weeks, for a total of three doses, with an oligonucleotide and dosage listed in Table 96 or with PBS. Each treatment group consisted of 4 animals. Prior to the first dose, a tail bleed was performed to determine plasma TTR protein levels at baseline (BL). The mice were sacrificed 72 hours following the final administration. TTR protein levels were measured using a clinical analyzer (AU480, Beckman Coulter, Calif.). Real-time PCR and RIBOGREEN® RNA quantification reagent (Molecular Probes, Inc. Eugene, Oreg.) were used according to standard protocols to determine liver human TTR mRNA levels. The results presented in Table 96 are the average values for each treatment group. The

TABLE 95

Oligonucleotides targeting human TTR

| Isis No. | Sequence 5' to 3' | Linkages | GalNAc cluster | CM | SEQ ID No. |
|---|---|---|---|---|---|
| 420915 | $T_{es}{}^mC_{es}T_{es}T_{es}G_{es}G_{ds}T_{ds}T_{ds}A_{ds}{}^mC_{ds}A_{ds}T_{ds}G_{ds}A_{ds}A_{ds}A_{es}T_{es}{}^mC_{es}{}^mC_{es}{}^mC_e$ | PS | n/a | n/a | 4899 |
| 682883 | GalNAc$_3$-3$_{a-o'}$$T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-3a | PO | 4899 |
| 666943 | GalNAc$_3$-3$_{a-o'}$$A_{do}T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-3a | $A_d$ | 4904 |
| 682887 | GalNAc$_3$-7$_{a-o'}$$A_{do}T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-7a | $A_d$ | 4904 |
| 682888 | GalNAc$_3$-10$_{a-o'}$$A_{do}T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-10a | $A_d$ | 4904 |
| 682889 | GalNAc$_3$-13$_{a-o'}$$A_{do}T_{es}{}^mC_{eo}T_{eo}T_{eo}G_{eo}G_{ds}T_{ds}T_{ds}A_{ds}{}^mC_{ds}A_{ds}T_{ds}G_{ds}A_{ds}A_{ds}A_{eo}T_{eo}{}^mC_{es}{}^mC_{es}{}^mC_e$ | PS/PO | GalNAc$_3$-13a | $A_d$ | 4904 |

The legend for Table 95 can be found in Example 74. The structure of GalNAc$_3$-3$_a$ was shown in Example 39. The structure of GalNAc$_3$-7$_a$ was shown in Example 48. The structure of GalNAc$_3$-10$_a$ was shown in Example 46. The structure of GalNAc$_3$-13$_a$ was shown in Example 62.

TABLE 96

Antisense inhibition of human TTR in vivo

| Isis No. | Dosage (mg/kg) | TTR mRNA (% PBS) | TTR protein (% BL) | GalNAc cluster | CM |
|---|---|---|---|---|---|
| PBS | n/a | 100 | 124 | n/a | n/a |
| 420915 | 6 | 69 | 114 | n/a | n/a |
|  | 20 | 71 | 86 |  |  |
|  | 60 | 21 | 36 |  |  |
| 682883 | 0.6 | 61 | 73 | GalNAc$_3$-3a | PO |
|  | 2 | 23 | 36 |  |  |
|  | 6 | 18 | 23 |  |  |
| 666943 | 0.6 | 74 | 93 | GalNAc$_3$-3a | $A_d$ |
|  | 2 | 33 | 57 |  |  |
|  | 6 | 17 | 22 |  |  |
| 682887 | 0.6 | 60 | 97 | GalNAc$_3$-7a | $A_d$ |
|  | 2 | 36 | 49 |  |  |
|  | 6 | 12 | 19 |  |  |
| 682888 | 0.6 | 65 | 92 | GalNAc$_3$-10a | $A_d$ |
|  | 2 | 32 | 46 |  |  |
|  | 6 | 17 | 22 |  |  |
| 682889 | 0.6 | 72 | 74 | GalNAc$_3$-13a | $A_d$ |
|  | 2 | 38 | 45 |  |  |
|  | 6 | 16 | 18 |  |  |

Example 91

Antisense Inhibition In Vivo by Oligonucleotides Targeting Factor VII Comprising a GalNAc$_3$ Conjugate in Non-Human Primates Oligonucleotides listed in Table 97 below were tested in a non-terminal, dose escalation study for antisense inhibition of Factor VII in monkeys.

Treatment

Non-naïve monkeys were each injected subcutaneously on days 0, 15, and 29 with escalating doses of an oligonucleotide listed in Table 97 or with PBS. Each treatment group consisted of 4 males and 1 female. Prior to the first dose and at various time points thereafter, blood draws were performed to determine plasma Factor VII protein levels. Factor VII protein levels were measured by ELISA. The results presented in Table 98 are the average values for each treatment group relative to the average value for the PBS group at baseline (BL), the measurements taken just prior to the first dose. As illustrated in Table 98, treatment with antisense oligonucleotides lowered Factor VII expression levels in a dose-dependent manner, and the oligonucleotide comprising the GalNAc conjugate was significantly more potent in monkeys compared to the oligonucleotide lacking a GalNAc conjugate.

TABLE 97

Oligonucleotides targeting Factor VII

| Isis No. | Sequence 5' to 3' | Linkages | GalNAc cluster | CM | SEQ ID No. |
|---|---|---|---|---|---|
| 407935 | $A_{es}T_{es}G_{es}{}^mC_{es}A_{es}T_{ds}G_{ds}G_{ds}T_{ds}G_{ds}A_{ds}T_{ds}G_{ds}{}^mC_{ds}T_{ds}T_{es}{}^mC_{es}T_{es}G_{es}A_e$ | PS | n/a | n/a | 4905 |
| 686892 | GalNAc$_3$-10$_{a-o'}$$A_{es}T_{es}G_{es}{}^mC_{es}A_{es}T_{ds}G_{ds}G_{ds}T_{ds}G_{ds}A_{ds}T_{ds}G_{ds}{}^mC_{ds}T_{ds}T_{es}{}^mC_{es}T_{es}G_{es}A_e$ | PS | GalNAc$_3$-10a | PO | 4905 |

The legend for Table 97 can be found in Example 74. The structure of GalNAc$_3$-10$_a$ was shown in Example 46.

TABLE 98

Factor VII plasma protein levels

| ISIS No. | Day | Dose (mg/kg) | Factor VII (% BL) |
|---|---|---|---|
| 407935 | 0 | n/a | 100 |
| | 15 | 10 | 87 |
| | 22 | n/a | 92 |
| | 29 | 30 | 77 |
| | 36 | n/a | 46 |
| | 43 | n/a | 43 |
| 686892 | 0 | 3 | 100 |
| | 15 | 10 | 56 |
| | 22 | n/a | 29 |
| | 29 | 30 | 19 |
| | 36 | n/a | 15 |
| | 43 | n/a | 11 |

Example 92

Antisense Inhibition in Primary Hepatocytes by Antisense Oligonucleotides Targeting Apo-CIII Comprising a GalNAc$_3$ Conjugate Primary mouse hepatocytes were seeded in 96-well plates at 15,000 cells per well, and the oligonucleotides listed in Table 99, targeting mouse ApoC-III, were added at 0.46, 1.37, 4.12, or 12.35, 37.04, 111.11, or 333.33 nM or 1.00 µM. After incubation with the oligonucleotides for 24 hours, the cells were lysed and total RNA was purified using RNeasy (Qiagen). ApoC-III mRNA levels were determined using real-time PCR and RIBOGREEN® RNA quantification reagent (Molecular Probes, Inc.) according to standard protocols. IC$_{50}$ values were determined using Prism 4 software (GraphPad). The results show that regardless of whether the cleavable moiety was a phosphodiester or a phosphodiester-linked deoxyadensoine, the oligonucleotides comprising a GalNAc conjugate were significantly more potent than the parent oligonucleotide lacking a conjugate.

TABLE 99

Inhibition of mouse APOC-III expression in mouse primary hepatocytes

| ISIS No. | Sequence (5' to 3') | CM | IC$_{50}$ (nM) | SEQ ID No. |
|---|---|---|---|---|
| 440670 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$A$_{es}$G$_{es}$$^m$C$_{es}$A$_e$ | n/a | 13.20 | 4906 |
| 661180 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_{eo}$A$_{do}$'-GalNAc$_3$-1$_a$ | A$_d$ | 1.40 | 4907 |
| 680771 | GalNAc$_3$-3$_{a-o'}$$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_e$ | PO | 0.70 | 4906 |
| 680772 | GalNAc$_3$-7$_{a-o'}$$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_e$ | PO | 1.70 | 4906 |
| 680773 | GalNAc$_3$-10$_{a-o'}$$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_e$ | PO | 2.00 | 4906 |
| 680774 | GalNAc$_3$-13$_{a-o'}$$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_e$ | PO | 1.50 | 4906 |
| 681272 | GalNAc$_3$-3$_{a-o'}$$^m$C$_{es}$A$_{eo}$G$_{eo}$$^m$C$_{eo}$T$_{eo}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{eo}$ A$_{eo}$G$_{es}$$^m$C$_{es}$A$_e$ | PO | <0.46 | 4906 |
| 681273 | GalNAc$_3$-3$_{a-o'}$A$_{do}$$^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$ $^m$C$_{es}$A$_{es}$G$_{es}$$^m$C$_{es}$A$_e$ | A$_d$ | 1.10 | 4908 |
| 683733 | $^m$C$_{es}$A$_{es}$G$_{es}$$^m$C$_{es}$T$_{es}$T$_{ds}$T$_{ds}$A$_{ds}$T$_{ds}$T$_{ds}$A$_{ds}$G$_{ds}$G$_{ds}$G$_{ds}$A$_{ds}$$^m$C$_{es}$ A$_{es}$G$_{es}$$^m$C$_{es}$A$_{eo}$A$_{do}$'-GalNAc$_3$-19$_a$ | A$_d$ | 2.50 | 4907 |

The structure of GalNAc$_3$-1$_a$ was shown previously in Example 9, GalNAc$_3$-3$_a$ was shown in Example 39, GalNAc$_3$-7$_a$ was shown in Example 48, GalNAc$_3$-10$_a$ was shown in Example 46, GalNAc$_3$-13$_a$ was shown in Example 62, and GalNAc$_3$-19$_a$ was shown in Example 70.

Example 93

Antisense Inhibition In Vivo by Oligonucleotides Targeting SRB-1 Comprising Mixed Wings and a 5'-GalNAc$_3$ Conjugate The oligonucleotides listed in Table 100 were tested in a dose-dependent study for antisense inhibition of SRB-1 in mice.

TABLE 100

Modified ASOs targeting SRB-1

| ISIS No. | Sequences (5' to 3') | GalNAc$_3$ Cluster | CM | SEQ ID No. |
|---|---|---|---|---|
| 449093 | T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | n/a | n/a | 4909 |
| 699806 | GalNAc$_3$-3$_{a-o'}$T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$ T$_{ds}$T$_{ks}$$^m$C$_{ks}$$^m$C$_k$ | GalNAc$_3$-3a | PO | 4909 |

TABLE 100-continued

Modified ASOs targeting SRB-1

| ISIS No. | Sequences (5' to 3') | GalNAc$_3$ Cluster | CM | SEQ ID No. |
|---|---|---|---|---|
| 699807 | GalNAc$_3$-7$_{a'o'}$T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | GalNAc$_3$-7a | PO | 4909 |
| 699809 | GalNAc$_3$-7$_{a'o'}$T$_{ks}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_e$ | GalNAc$_3$-7a | PO | 4909 |
| 699811 | GalNAc$_3$-7$_{a'o'}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_k$ | GalNAc$_3$-7a | PO | 4909 |
| 699813 | GalNAc$_3$-7$_{a'o'}$T$_{ks}$T$_{ds}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ds}$$^m$C$_k$ | GalNAc$_3$-7a | PO | 4909 |
| 699815 | GalNAc$_3$-7$_{a'o'}$T$_{es}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_{ks}$$^m$C$_e$ | GalNAc$_3$-7a | PO | 4909 |

The structure of GalNAc$_3$-3$_a$ was shown previously in Example 39, and the structure of GalNAc$_3$-7a was shown previously in Example 48. Subscripts: "e" indicates 2'-MOE modified nucleoside; "d" indicates β-D-2'-deoxyribonucleoside; "k" indicates 6'-(S)—CH$_3$ bicyclic nucleoside (cEt); "s" indicates phosphorothioate internucleoside linkages (PS); "o" indicates phosphodiester internucleoside linkages (PO). Supersript "m" indicates 5-methylcytosines.

Treatment

Six to eight week old C57BL/6 mice (Jackson Laboratory, Bar Harbor, Me.) were injected subcutaneously once at the dosage shown below with an oligonucleotide listed in Table 100 or with saline. Each treatment group consisted of 4 animals. The mice were sacrificed 72 hours following the final administration. Liver SRB-1 mRNA levels were measured using real-time PCR. SRB-1 mRNA levels were normalized to cyclophilin mRNA levels according to standard protocols. The results are presented as the average percent of SRB-1 mRNA levels for each treatment group relative to the saline control group. As illustrated in Table 101, treatment with antisense oligonucleotides lowered SRB-1 mRNA levels in a dose-dependent manner, and the gapmer oligonucleotides comprising a GalNAc conjugate and having wings that were either full cEt or mixed sugar modifications were significantly more potent than the parent oligonucleotide lacking a conjugate and comprising full cEt modified wings.

Body weights, liver transaminases, total bilirubin, and BUN were also measured, and the average values for each treatment group are shown in Table 101. Body weight is shown as the average percent body weight relative to the baseline body weight (% BL) measured just prior to the oligonucleotide dose.

TABLE 101

SRB-1 mRNA, ALT, AST, BUN, and total bilirubin levels and body weights

| ISIS No. | Dosage (mg/kg) | SRB-1 mRNA (% PBS) | ALT (U/L) | AST (U/L) | Bil | BUN | Body weight (% BL) |
|---|---|---|---|---|---|---|---|
| PBS | n/a | 100 | 31 | 84 | 0.15 | 28 | 102 |
| 449093 | 1 | 111 | 18 | 48 | 0.17 | 31 | 104 |
|  | 3 | 94 | 20 | 43 | 0.15 | 26 | 103 |
|  | 10 | 36 | 19 | 50 | 0.12 | 29 | 104 |
| 699806 | 0.1 | 114 | 23 | 58 | 0.13 | 26 | 107 |
|  | 0.3 | 59 | 21 | 45 | 0.12 | 27 | 108 |
|  | 1 | 25 | 30 | 61 | 0.12 | 30 | 104 |
| 699807 | 0.1 | 121 | 19 | 41 | 0.14 | 25 | 100 |
|  | 0.3 | 73 | 23 | 56 | 0.13 | 26 | 105 |
|  | 1 | 24 | 22 | 69 | 0.14 | 25 | 102 |
| 699809 | 0.1 | 125 | 23 | 57 | 0.14 | 26 | 104 |
|  | 0.3 | 70 | 20 | 49 | 0.10 | 25 | 105 |
|  | 1 | 33 | 34 | 62 | 0.17 | 25 | 107 |
| 699811 | 0.1 | 123 | 48 | 77 | 0.14 | 24 | 106 |
|  | 0.3 | 94 | 20 | 45 | 0.13 | 25 | 101 |
|  | 1 | 66 | 57 | 104 | 0.14 | 24 | 107 |
| 699813 | 0.1 | 95 | 20 | 58 | 0.13 | 28 | 104 |
|  | 0.3 | 98 | 22 | 61 | 0.17 | 28 | 105 |
|  | 1 | 49 | 19 | 47 | 0.11 | 27 | 106 |
| 699815 | 0.1 | 93 | 30 | 79 | 0.17 | 25 | 105 |
|  | 0.3 | 64 | 30 | 61 | 0.12 | 26 | 105 |
|  | 1 | 24 | 18 | 41 | 0.14 | 25 | 106 |

Example 94

Antisense Inhibition In Vivo by Oligonucleotides Targeting SRB-1 Comprising 2'-Sugar Modifications and a 5'-GalNAc$_3$ Conjugate The oligonucleotides listed in Table 102 were tested in a dose-dependent study for antisense inhibition of SRB-1 in mice.

TABLE 102

Modified ASOs targeting SRB-1

| ISIS No. | Sequences (5' to 3') | GalNAc$_3$ Cluster | CM | SEQ ID No. |
|---|---|---|---|---|
| 353382 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | n/a | n/a | 4886 |
| 700989 | G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_m$ | n/a | n/a | 4910 |
| 666904 | GalNAc$_3$-3$_{a-o'}$G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_3$-3a | PO | 4886 |
| 700991 | GalNAc$_3$-7$_{a-o'}$G$_{ms}$C$_{ms}$U$_{ms}$U$_{ms}$C$_{ms}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$U$_{ms}$C$_{ms}$C$_{ms}$U$_{ms}$U$_m$ | GalNAc$_3$-7a | PO | 4910 |

Subscript "m" indicates a 2'-O-methyl modified nucleoside. See Example 74 for complete table legend. The structure of GalNAc$_3$-3$_a$ was shown previously in Example 39, and the structure of GalNAc$_3$-7a was shown previously in Example 48.

Treatment

The study was completed using the protocol described in Example 93. Results are shown in Table 103 below and show that both the 2'-MOE and 2'-OMe modified oligonucleotides comprising a GalNAc conjugate were significantly more potent than the respective parent oligonucleotides lacking a conjugate. The results of the body weights, liver transaminases, total bilirubin, and BUN measurements indicated that the compounds were all well tolerated.

TABLE 103

SRB-1 mRNA

| ISIS No. | Dosage (mg/kg) | SRB-1 mRNA (% PBS) |
|---|---|---|
| PBS | n/a | 100 |
| 353382 | 5 | 116 |
|  | 15 | 58 |
|  | 45 | 27 |
| 700989 | 5 | 120 |
|  | 15 | 92 |
|  | 45 | 46 |
| 666904 | 1 | 98 |
|  | 3 | 45 |
|  | 10 | 17 |
| 700991 | 1 | 118 |
|  | 3 | 63 |
|  | 10 | 14 |

Example 95

Antisense Inhibition In Vivo by Oligonucleotides Targeting SRB-1 Comprising Bicyclic Nucleosides and a 5'-GalNAc$_3$ Conjugate The oligonucleotides listed in Table 104 were tested in a dose-dependent study for antisense inhibition of SRB-1 in mice.

TABLE 104

Modified ASOs targeting SRB-1

| ISIS No. | Sequences (5' to 3') | GalNAc$_3$ Cluster | CM | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | n/a | n/a | 4880 |
| 666905 | GalNAc$_3$-3$_{a-o'}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-3$_a$ | PO | 4880 |
| 699782 | GalNAc$_3$-7$_{a-o'}$T$_{ks}$$^m$C$_{ks}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ks}$$^m$C$_k$ | GalNAc$_3$-7$_a$ | PO | 4880 |
| 699783 | GalNAc$_3$-3$_{a-o'}$T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_l$ | GalNAc$_3$-3$_a$ | PO | 4880 |
| 653621 | T$_{ls}$$^m$C$_{ls}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{ls}$$^m$C$_{lo}$A$_{do}$-GalNAc$_3$-1$_a$ | GalNAc$_3$-1$_a$ | A$_d$ | 4881 |
| 439879 | T$_{gs}$$^m$C$_{gs}$A$_{ds}$G$_{ds}$T$_{ds}$$^m$C$_{ds}$A$_{ds}$T$_d$G$_{ds}$A$_{ds}$$^m$C$_{ds}$T$_{ds}$T$_{gs}$$^m$C$_g$ | n/a | n/a | 4880 |
| 699789 | GalNAc$_3$-3$_{a-o'}$T$_{gs}$$^m$C$_{gs}$A$_{ds}$G$_{ds}$T$_{ds}$$^m$C$_{ds}$A$_{ds}$T$_d$G$_{ds}$A$_{ds}$$^m$C$_{ds}$T$_{ds}$T$_{gs}$$^m$C$_g$ | GalNAc$_3$-3$_a$ | PO | 4880 |

Subscript "g" indicates a fluoro-HNA nucleoside, subscript "l" indicates a locked nucleoside comprising a 2'-O—CH$_2$-4' bridge. See the Example 74 table legend for other abbreviations. The structure of GalNAc$_3$-1$_a$ was shown previously in Example 9, the structure of GalNAc$_3$-3$_a$ was shown previously in Example 39, and the structure of GalNAc$_3$-7a was shown previously in Example 48.

Treatment

The study was completed using the protocol described in Example 93. Results are shown in Table 105 below and show that oligonucleotides comprising a GalNAc conjugate and various bicyclic nucleoside modifications were significantly more potent than the parent oligonucleotide lacking a conjugate and comprising bicyclic nucleoside modifications. Furthermore, the oligonucleotide comprising a GalNAc conjugate and fluoro-HNA modifications was significantly more potent than the parent lacking a conjugate and comprising fluoro-HNA modifications. The results of the body weights, liver transaminases, total bilirubin, and BUN measurements indicated that the compounds were all well tolerated.

TABLE 105

SRB-1 mRNA, ALT, AST, BUN, and total bilirubin levels and body weights

| ISIS No. | Dosage (mg/kg) | SRB-1 mRNA (% PBS) |
|---|---|---|
| PBS | n/a | 100 |
| 440762 | 1 | 104 |
|  | 3 | 65 |
|  | 10 | 35 |
| 666905 | 0.1 | 105 |
|  | 0.3 | 56 |
|  | 1 | 18 |
| 699782 | 0.1 | 93 |
|  | 0.3 | 63 |
|  | 1 | 15 |
| 699783 | 0.1 | 105 |
|  | 0.3 | 53 |
|  | 1 | 12 |
| 653621 | 0.1 | 109 |
|  | 0.3 | 82 |
|  | 1 | 27 |
| 439879 | 1 | 96 |
|  | 3 | 77 |
|  | 10 | 37 |
| 699789 | 0.1 | 82 |
|  | 0.3 | 69 |
|  | 1 | 26 |

Example 96

Plasma Protein Binding of Antisense Oligonucleotides Comprising a GalNAc$_3$ Conjugate Group Oligonucleotides listed in Table 70 targeting ApoC-III and oligonucleotides in Table 106 targeting Apo(a) were tested in an ultra-filtration assay in order to assess plasma protein binding.

TABLE 106

Modified oligonucleotides targeting Apo(a)

| ISIS No. | Sequences (5' to 3') | GalNAc$_3$ Cluster | CM | SEQ ID No |
|---|---|---|---|---|
| 494372 | T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_{e}$ | n/a | n/a | 4903 |
| 693401 | T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | n/a | n/a | 4903 |
| 681251 | GalNAc$_3$-7$_{a-o'}$T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_{e}$ | GalNAc$_3$-7$_a$ | PO | 4903 |
| 681257 | GalNAc$_3$-7$_{a-o'}$T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_{e}$ | GalNAc$_3$-7$_a$ | PO | 4903 |

See the Example 74 for table legend. The structure of GalNAc$_3$-7a was shown previously in Example 48.

Ultrafree-MC ultrafiltration units (30,000 NMWL, low-binding regenerated cellulose membrane, Millipore, Bedford, Mass.) were pre-conditioned with 300 μL of 0.5% Tween 80 and centrifuged at 2000 g for 10 minutes, then with 300 μL of a 300 μg/mL solution of a control oligonucleotide in H$_2$O and centrifuged at 2000 g for 16 minutes. In order to assess non-specific binding to the filters of each test oligonucleotide from Tables 70 and 106 to be used in the studies, 300 μL of a 250 ng/mL solution of oligonucleotide in H$_2$O at pH 7.4 was placed in the pre-conditioned filters and centrifuged at 2000 g for 16 minutes. The unfiltered and filtered samples were analyzed by an ELISA assay to determine the oligonucleotide concentrations. Three replicates were used to obtain an average concentration for each sample. The average concentration of the filtered sample relative to the unfiltered sample is used to determine the percent of oligonucleotide that is recovered through the filter in the absence of plasma (% recovery).

Frozen whole plasma samples collected in K3-EDTA from normal, drug-free human volunteers, cynomolgus monkeys, and CD-1 mice, were purchased from Bioreclamation LLC (Westbury, N.Y.). The test oligonucleotides were added to 1.2 mL aliquots of plasma at two concentrations (5 and 150 μg/mL). An aliquot (300 μL) of each spiked plasma sample was placed in a pre-conditioned filter unit and incubated at 37° C. for 30 minutes, immediately followed by centrifugation at 2000 g for 16 minutes. Aliquots of filtered and unfiltered spiked plasma samples were analyzed by an ELISA to determine the oligonucleotide concentration in each sample. Three replicates per concentration were used to determine the average percentage of bound and unbound oligonucleotide in each sample. The average concentration of the filtered sample relative to the concentration of the unfiltered sample is used to determine the percent of oligonucleotide in the plasma that is not bound to plasma proteins (% unbound). The final unbound oligonucleotide values are corrected for non-specific binding by dividing the % unbound by the % recovery for each oligonucleotide. The final % bound oligonucleotide values are determined by subtracting the final % unbound values from 100. The results are shown in Table 107 for the two concentrations of oligonucleotide tested (5 and 150 μg/mL) in each species of plasma. The results show that GalNAc conjugate groups do not have a significant impact on plasma protein binding. Furthermore, oligonucleotides with full PS internucleoside linkages and mixed PO/PS linkages both bind plasma proteins, and those with full PS linkages bind plasma proteins to a somewhat greater extent than those with mixed PO/PS linkages.

TABLE 107

Percent of modified oligonucleotide bound to plasma proteins

| ISIS No. | Human plasma | | Monkey plasma | | Mouse plasma | |
|---|---|---|---|---|---|---|
|  | 5 μg/mL | 150 μg/mL | 5 μg/mL | 150 μg/mL | 5 μg/mL | 150 μg/mL |
| 304801 | 99.2 | 98.0 | 99.8 | 99.5 | 98.1 | 97.2 |
| 663083 | 97.8 | 90.9 | 99.3 | 99.3 | 96.5 | 93.0 |
| 674450 | 96.2 | 97.0 | 98.6 | 94.4 | 94.6 | 89.3 |
| 494372 | 94.1 | 89.3 | 98.9 | 97.5 | 97.2 | 93.6 |
| 693401 | 93.6 | 89.9 | 96.7 | 92.0 | 94.6 | 90.2 |
| 681251 | 95.4 | 93.9 | 99.1 | 98.2 | 97.8 | 96.1 |
| 681257 | 93.4 | 90.5 | 97.6 | 93.7 | 95.6 | 92.7 |

Example 97

Modified Oligonucleotides Targeting TTR Comprising a GalNAc₃ Conjugate Group The oligonucleotides shown in Table 108 comprising a GalNAc conjugate were designed to target TTR.

TABLE 108

Modified oligonucleotides targeting TTR

| ISIS No. | Sequences (5' to 3') | GalNAc₃ Cluster | CM | SEQ ID No |
|---|---|---|---|---|
| 666941 | GalNAc₃-3$_{a-o'}$A$_{do}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-3 | A$_d$ | 4904 |
| 666942 | T$_{es}$$^m$C$_{eo}$T$_{eo}$T$_{eo}$G$_{eo}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{eo}$T$_{eo}$$^m$C$_{es}$$^m$C$_{es}$$^m$C$_{eo}$A$_{do'}$-GalNAc₃-3$_a$ | GalNAc₃-1 | A$_d$ | 4904 |
| 682876 | GalNAc₃-3$_{a-o'}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-3 | PO | 4899 |
| 682877 | GalNAc₃-7$_{a-o'}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-7 | PO | 4899 |
| 682878 | GalNAc₃-10$_{a-o'}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-10 | PO | 4899 |
| 682879 | GalNAc₃-13$_{a-o'}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-13 | PO | 4899 |
| 682880 | GalNAc₃-7$_{a-o'}$A$_{do}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-7 | A$_d$ | 4904 |
| 682881 | GalNAc₃-10$_{a-o'}$A$_{do}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-10 | A$_d$ | 4904 |
| 682882 | GalNAc₃-13$_{a-o'}$A$_{do}$T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_e$ | GalNAc₃-13 | A$_d$ | 4904 |
| 684056 | T$_{es}$$^m$C$_{es}$T$_{es}$T$_{es}$G$_{es}$G$_{ds}$T$_{ds}$T$_{ds}$A$_{ds}$$^m$C$_{ds}$A$_{ds}$T$_{ds}$G$_{ds}$A$_{ds}$A$_{ds}$A$_{es}$T$_{es}$$^m$C$_{es}$$^m$C$_{es}$$^m$C$_{eo}$A$_{do'}$-GalNAc₃-19$_a$ | GalNAc₃-19 | A$_d$ | 4900 |

The legend for Table 108 can be found in Example 74. The structure of GalNAc₃-1 was shown in Example 9. The structure of GalNAc₃-3$_a$ was shown in Example 39. The structure of GalNAc₃-7$_a$ was shown in Example 48. The structure of GalNAc₃-10$_a$ was shown in Example 46. The structure of GalNAc₃-13$_a$ was shown in Example 62. The structure of GalNAc₃-19$_a$ was shown in Example 70.

Example 98

Evaluation of Pro-Inflammatory Effects of Oligonucleotides Comprising a GalNAc Conjugate in hPMBC Assay The oligonucleotides listed in Table 109 and were tested for pro-inflammatory effects in an hPMBC assay as described in Examples 23 and 24. (See Tables 30, 83, 95, and 108 for descriptions of the oligonucleotides.) ISIS 353512 is a high responder used as a positive control, and the other oligonucleotides are described in Tables 83, 95, and 108. The results shown in Table 109 were obtained using blood from one volunteer donor. The results show that the oligonucleotides comprising mixed PO/PS internucleoside linkages produced significantly lower pro-inflammatory responses compared to the same oligonucleotides having full PS linkages. Furthermore, the GalNAc conjugate group did not have a significant effect in this assay.

TABLE 109

| ISIS No. | E$_{max}$/EC$_{50}$ | GalNAc₃ cluster | Linkages | CM |
|---|---|---|---|---|
| 353512 | 3630 | n/a | PS | n/a |
| 420915 | 802 | n/a | PS | n/a |
| 682881 | 1311 | GalNAc₃-10 | PS | A$_d$ |

TABLE 109-continued

| ISIS No. | E$_{max}$/EC$_{50}$ | GalNAc₃ cluster | Linkages | CM |
|---|---|---|---|---|
| 682888 | 0.26 | GalNAc₃-10 | PO/PS | A$_d$ |
| 684057 | 1.03 | GalNAc₃-19 | PO/PS | A$_d$ |

Example 99

Binding Affinities of Oligonucleotides Comprising a GalNAc Conjugate for the Asialoglycoprotein Receptor The binding affinities of the oligonucleotides listed in Table 110 (see Table 76 for descriptions of the oligonucleotides) for the asialoglycoprotein receptor were tested in a competitive receptor binding assay. The competitor ligand, al-acid glycoprotein (AGP), was incubated in 50 mM sodium acetate buffer (pH 5) with 1 U neuraminidase-agarose for 16 hours at 37° C., and >90% desialylation was confirmed by either sialic acid assay or size exclusion chromatography (SEC). Iodine monochloride was used to iodinate the AGP according to the procedure by Atsma et al. (see J Lipid Res. 1991 January; 32(1):173-81.) In this method, desialylated α1-acid glycoprotein (de-AGP) was added to 10 mM iodine chloride, Na$^{125}$I, and 1 M glycine in 0.25 M NaOH. After incubation for 10 minutes at room temperature, $^{125}$I-labeled de-AGP was separated from free $^{125}$I by concentrating the mixture twice utilizing a 3 KDMWCO spin column. The protein was tested for labeling efficiency and purity on a HPLC system equipped with an Agilent SEC-3 column (7.8× 300 mm) and a β-RAM counter. Competition experiments utilizing $^{125}$I-labeled de-AGP and various GalNAc-cluster containing ASOs were performed as follows. Human HepG2 cells (10$^6$ cells/ml) were plated on 6-well plates in 2 ml of appropriate growth media. MEM media supplemented with 10% fetal bovine serum (FBS), 2 mM L-Glutamine and 10 mM HEPES was used. Cells were incubated 16-20 hours @ 37° C. with 5% and 10% CO$_2$ respectively. Cells were washed with media without FBS prior to the experiment. Cells were incubated for 30 min @37° C. with 1 ml competition mix containing appropriate growth media with 2% FBS, 10$^{-8}$ M $^{125}$I-labeled de-AGP and GalNAc-cluster containing ASOs at concentrations ranging from $10^{-11}$ to $10^{-5}$ M. Non-specific binding was determined in the presence of $10^{-2}$ M GalNAc sugar. Cells were washed twice with media without FBS to remove unbound $^{125}$I-labeled de-AGP and competitor GalNAc ASO. Cells were lysed using Qiagen's RLT buffer containing 1% β-mercaptoethanol. Lysates were transferred to round bottom assay tubes after a brief 10 min freeze/thaw cycle and assayed on a γ-counter. Non-specific binding was subtracted before dividing $^{125}$I protein counts by the value of the lowest GalNAc-ASO concentration counts. The inhibition curves were fitted according to a single site competition binding equation using a nonlinear regression algorithm to calculate the binding affinities ($K_D$'s).

The results in Table 110 were obtained from experiments performed on five different days. Results for oligonucleotides marked with superscript "a" are the average of experiments run on two different days. The results show that the oligonucleotides comprising a GalNAc conjugate group on the 5'-end bound the asialoglycoprotein receptor on human HepG2 cells with 1.5 to 16-fold greater affinity than the oligonucleotides comprising a GalNAc conjugate group on the 3'-end.

TABLE 110

Asialoglycoprotein receptor binding assay results

| ISIS No. | GalNAc conjugate | Oligonucleotide end to which GalNAc conjugate is attached | $K_D$ (nM) |
|---|---|---|---|
| 661161$^a$ | GalNAc$_3$-3 | 5' | 3.7 |
| 666881$^a$ | GalNAc$_3$-10 | 5' | 7.6 |
| 666981 | GalNAc$_3$-7 | 5' | 6.0 |
| 670061 | GalNAc$_3$-13 | 5' | 7.4 |
| 655861$^a$ | GalNAc$_3$-1 | 3' | 11.6 |
| 677841$^a$ | GalNAc$_3$-19 | 3' | 60.8 |

Example 100

Antisense Inhibition In Vivo by Oligonucleotides Comprising a GalNAc Conjugate Group Targeting Apo(a) In Vivo The oligonucleotides listed in Table 111a below were tested in a single dose study for duration of action in mice.

TABLE 111a

Modified ASOs targeting APO(a)

| ISIS No. | Sequences (5' to 3') | GalNAc$_3$ Cluster | CM | SEQ ID No. |
|---|---|---|---|---|
| 681251 | GalNAc$_3$-7$_{a'-o'}$T$_{es}$G$_{es}$$^m$C$_{es}$T$_{es}$$^m$C$_{es}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{es}$G$_{es}$T$_{es}$T$_{es}$$^m$C$_e$ | GalNAc$_3$-7a | PO | 4903 |
| 681257 | GalNAc$_3$-7$_{a'-o'}$T$_{es}$G$_{eo}$$^m$C$_{eo}$T$_{eo}$$^m$C$_{eo}$$^m$C$_{ds}$G$_{ds}$T$_{ds}$T$_{ds}$G$_{ds}$G$_{ds}$T$_{ds}$G$_{ds}$$^m$C$_{ds}$T$_{ds}$T$_{eo}$G$_{eo}$T$_{es}$T$_{es}$$^m$C$_e$ | GalNAc$_3$-7a | PO | 4903 |

The structure of GalNAc$_3$-7$_a$ was shown in Example 48. Treatment

Female transgenic mice that express human Apo(a) were each injected subcutaneously once per week, for a total of 6 doses, with an oligonucleotide and dosage listed in Table 111b or with PBS. Each treatment group consisted of 3 animals. Blood was drawn the day before dosing to determine baseline levels of Apo(a) protein in plasma and at 72 hours, 1 week, and 2 weeks following the first dose. Additional blood draws will occur at 3 weeks, 4 weeks, 5 weeks, and 6 weeks following the first dose. Plasma Apo(a) protein levels were measured using an ELISA. The results in Table 111b are presented as the average percent of plasma Apo(a) protein levels for each treatment group, normalized to baseline levels (% BL). The results show that the oligonucleotides comprising a GalNAc conjugate group exhibited potent reduction in Apo(a) expression. This potent effect was observed for the oligonucleotide that comprises full PS internucleoside linkages and the oligonucleotide that comprises mixed PO and PS linkages.

TABLE 111b

Apo(a) plasma protein levels

| ISIS No. | Dosage (mg/kg) | Apo(a) at 72 hours (% BL) | Apo(a) at 1 week (% BL) | Apo(a) at 3 weeks (% BL) |
|---|---|---|---|---|
| PBS | n/a | 116 | 104 | 107 |
| 681251 | 0.3 | 97 | 108 | 93 |
|  | 1.0 | 85 | 77 | 57 |
|  | 3.0 | 54 | 49 | 11 |
|  | 10.0 | 23 | 15 | 4 |
| 681257 | 0.3 | 114 | 138 | 104 |
|  | 1.0 | 91 | 98 | 54 |
|  | 3.0 | 69 | 40 | 6 |
|  | 10.0 | 30 | 21 | 4 |

Example 101

Antisense Inhibition by Oligonucleotides Comprising a GalNAc Cluster Linked Via a Stable Moiety The oligonucleotides listed in Table 112 were tested for inhibition of mouse APOC-III expression in vivo. C57B1/6 mice were each injected subcutaneously once with an oligonucleotide listed in Table 112 or with PBS. Each treatment group consisted of 4 animals. Each mouse treated with ISIS 440670 received a dose of 2, 6, 20, or 60 mg/kg. Each mouse treated with ISIS 680772 or 696847 received 0.6, 2, 6, or 20 mg/kg. The GalNAc conjugate group of ISIS 696847 is linked via a stable moiety, a phosphorothioate linkage instead of a readily cleavable phosphodiester containing linkage. The animals were sacrificed 72 hours after the dose. Liver APOC-III mRNA levels were measured using real-time PCR. APOC-III mRNA levels were normalized to cyclophilin mRNA levels according to standard protocols. The results are presented in Table 112 as the average percent of APOC-III mRNA levels for each treatment group relative to the saline control group. The results show that the oligonucleotides comprising a GalNAc conjugate group were significantly more potent than the oligonucleotide lacking a conjugate group. Furthermore, the oligonucleotide comprising a GalNAc conjugate group linked to the oligonucleotide via a cleavable moiety (ISIS 680772) was even more potent than the oligonucleotide comprising a GalNAc conjugate group linked to the oligonucleotide via a stable moiety (ISIS 696847).

TABLE 112

Modified oligonucleotides targeting mouse APOC-III

| ISIS No. | Sequences (5' to 3') | CM | Dosage (mg/kg) | APOC-III mRNA (% PBS) | SEQ ID No. |
|---|---|---|---|---|---|
| 440670 | $^mC_{es}A_{es}G_{es}{}^mC_{es}T_{es}T_{ds}T_{ds}$ $A_{ds}T_{ds}T_{ds}A_{ds}G_{ds}G_{ds}G_{ds}$ $A_{ds}{}^mC_{es}A_{es}G_{es}{}^mC_{es}A_{e}$ | n/a | 2<br>6<br>20<br>60 | 92<br>86<br>59<br>37 | 4906 |
| 680772 | GalNAc$_3$-7$_{a-o'}{}^mC_{es}A_{es}G_{es}$ $^mC_{es}T_{es}T_{ds}T_{ds}A_{ds}T_{ds}T_{ds}$ $A_{ds}G_{ds}G_{ds}G_{ds}A_{ds}{}^mC_{es}A_{es}$ $G_{es}{}^mC_{es}A_{e}$ | PO | 0.6<br>2<br>6<br>20 | 79<br>58<br>31<br>13 | 4906 |
| 696847 | GalNAc$_3$-7$_{a-s'}{}^mC_{es}A_{es}G_{es}$ $^mC_{es}T_{es}T_{ds}T_{ds}A_{ds}T_{ds}T_{ds}$ $A_{ds}G_{ds}G_{ds}G_{ds}A_{ds}{}^mC_{es}A_{es}$ $G_{es}{}^mC_{es}A_{e}$ | n/a<br>PS | 0.6<br>2<br>6<br>20 | 83<br>73<br>40<br>28 | 4906 |

The structure of GalNAc$_3$-7$_a$ was shown in Example 48.

Example 102

Distribution in Liver of Antisense Oligonucleotides Comprising a GalNAc Conjugate The liver distribution of ISIS 353382 (see Table 36) that does not comprise a GalNAc conjugate and ISIS 655861 (see Table 36) that does comprise a GalNAc conjugate was evaluated. Male balb/c mice were subcutaneously injected once with ISIS 353382 or 655861 at a dosage listed in Table 113. Each treatment group consisted of 3 animals except for the 18 mg/kg group for ISIS 655861, which consisted of 2 animals. The animals were sacrificed 48 hours following the dose to determine the liver distribution of the oligonucleotides. In order to measure the number of antisense oligonucleotide molecules per cell, a Ruthenium (II) tris-bipyridine tag (MSD TAG, Meso Scale Discovery) was conjugated to an oligonucleotide probe used to detect the antisense oligonucleotides. The results presented in Table 113 are the average concentrations of oligonucleotide for each treatment group in units of millions of oligonucleotide molecules per cell. The results show that at equivalent doses, the oligonucleotide comprising a GalNAc conjugate was present at higher concentrations in the total liver and in hepatocytes than the oligonucleotide that does not comprise a GalNAc conjugate. Furthermore, the oligonucleotide comprising a GalNAc conjugate was present at lower concentrations in non-parenchymal liver cells than the oligonucleotide that does not comprise a GalNAc conjugate. And while the concentrations of ISIS 655861 in hepatocytes and non-parenchymal liver cells were similar per cell, the liver is approximately 80% hepatocytes by volume. Thus, the majority of the ISIS 655861 oligonucleotide that was present in the liver was found in hepatocytes, whereas the majority of the ISIS 353382 oligonucleotide that was present in the liver was found in non-parenchymal liver cells.

TABLE 113

| ISIS No. | Dosage (mg/kg) | Concentration in whole liver (molecules * 10^6 per cell) | Concentration in hepatocytes (molecules * 10^6 per cell) | Concentration in non-parenchymal liver cells (molecules * 10^6 per cell) |
|---|---|---|---|---|
| 353382 | 3 | 9.7 | 1.2 | 37.2 |
| | 10 | 17.3 | 4.5 | 34.0 |
| | 20 | 23.6 | 6.6 | 65.6 |
| | 30 | 29.1 | 11.7 | 80.0 |
| | 60 | 73.4 | 14.8 | 98.0 |
| | 90 | 89.6 | 18.5 | 119.9 |
| 655861 | 0.5 | 2.6 | 2.9 | 3.2 |
| | 1 | 6.2 | 7.0 | 8.8 |
| | 3 | 19.1 | 25.1 | 28.5 |
| | 6 | 44.1 | 48.7 | 55.0 |
| | 18 | 76.6 | 82.3 | 77.1 |

Example 103

Duration of Action In Vivo of Oligonucleotides Targeting APOC-III Comprising a GalNAc$_3$ Conjugate The oligonucleotides listed in Table 114 below were tested in a single dose study for duration of action in mice.

TABLE 114

Modified ASOs targeting APOC-III

| ISIS No. | Sequences (5' to 3') | GalNAc$_3$ Cluster | CM | SEQ ID No. |
|---|---|---|---|---|
| 304801 | $A_{es}G_{es}{}^mC_{es}T_{es}T_{es}{}^mC_{ds}T_{ds}$ $T_{ds}G_{ds}T_{ds}{}^mC_{ds}{}^mC_{ds}A_{ds}G_{ds}$ $^mC_{ds}T_{es}T_{es}T_{es}A_{es}T_{e}$ | n/a | n/a | 4878 |
| 663084 | GalNAc$_3$-3$_{a-o'}A_{do}A_{es}G_{eo}$ $^mC_{eo}T_{eo}T_{eo}{}^mC_{ds}T_{ds}T_{ds}G_{ds}$ $T_{ds}{}^mC_{ds}{}^mC_{ds}A_{ds}G_{ds}{}^mC_{ds}T_{eo}$ $T_{eo}T_{es}A_{es}T_{e}$ | GalNAc$_3$-3a | $A_d$ | 4894 |
| 679241 | $A_{es}G_{eo}{}^mC_{eo}T_{eo}T_{eo}{}^mC_{ds}T_{ds}$ GalNAc$_3$-19a $T_{ds}G_{ds}T_{ds}{}^mC_{ds}{}^mC_{ds}A_{ds}G_{ds}$ $^mC_{ds}T_{eo}T_{eo}T_{es}A_{es}T_{eo}A_{do'-}$ GalNAc$_3$-19$_a$ | GalNAc$_3$-19a | $A_d$ | 4879 |

The structure of GalNAc$_3$-3$_a$ was shown in Example 39, and GalNAc$_3$-19$_a$ was shown in Example 70.

Treatment

Female transgenic mice that express human APOC-III were each injected subcutaneously once with an oligonucleotide listed in Table 114 or with PBS. Each treatment group consisted of 3 animals. Blood was drawn before dosing to determine baseline and at 3, 7, 14, 21, 28, 35, and 42 days following the dose. Plasma triglyceride and APOC-III protein levels were measured as described in Example 20. The results in Table 115 are presented as the average percent of plasma triglyceride and APOC-III levels for each treatment group, normalized to baseline levels. A comparison of the results in Table 71 of example 79 with the results in Table 115 below show that oligonucleotides comprising a mixture of phosphodiester and phosphorothioate internucleoside linkages exhibited increased duration of action than equivalent oligonucleotides comprising only phosphorothioate internucleoside linkages.

TABLE 115
Plasma triglyceride and APOC-III protein levels in transgenic mice
| ISIS No. | Dosage (mg/kg) | Time point (days post-dose) | Triglycerides (% baseline) | APOC-III protein (% baseline) | GalNAc$_3$ Cluster | CM |
|---|---|---|---|---|---|---|
| PBS | n/a | 3 | 96 | 101 | n/a | n/a |
| | | 7 | 88 | 98 | | |
| | | 14 | 91 | 103 | | |
| | | 21 | 69 | 92 | | |
| | | 28 | 83 | 81 | | |
| | | 35 | 65 | 86 | | |
| | | 42 | 72 | 88 | | |
| 304801 | 30 | 3 | 42 | 46 | n/a | n/a |
| | | 7 | 42 | 51 | | |
| | | 14 | 59 | 69 | | |
| | | 21 | 67 | 81 | | |
| | | 28 | 79 | 76 | | |
| | | 35 | 72 | 95 | | |
| | | 42 | 82 | 92 | | |
| 663084 | 10 | 3 | 35 | 28 | GalNAc$_3$-3a | A$_d$ |
| | | 7 | 23 | 24 | | |
| | | 14 | 23 | 26 | | |
| | | 21 | 23 | 29 | | |
| | | 28 | 30 | 22 | | |
| | | 35 | 32 | 36 | | |
| | | 42 | 37 | 47 | | |
| 679241 | 10 | 3 | 38 | 30 | GalNAc$_3$-19a | A$_d$ |
| | | 7 | 31 | 28 | | |
| | | 14 | 30 | 22 | | |
| | | 21 | 36 | 34 | | |
| | | 28 | 48 | 34 | | |
| | | 35 | 50 | 45 | | |
| | | 42 | 72 | 64 | | |
Example 104
Synthesis of Oligonucleotides Comprising a 5'-GalNAc$_2$ Conjugate
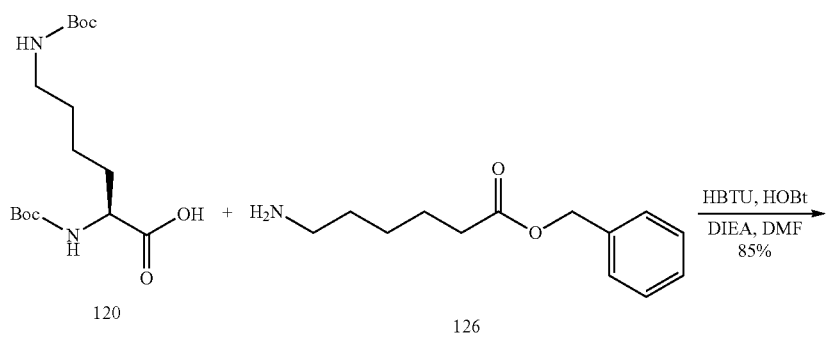
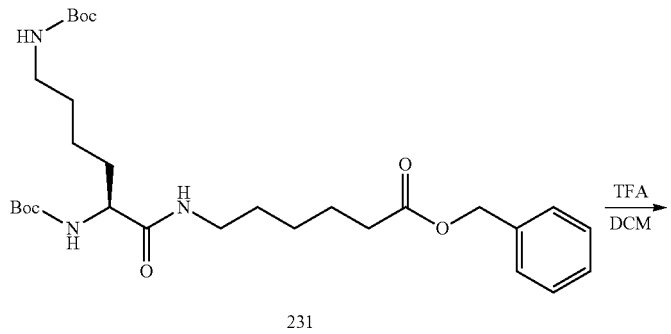
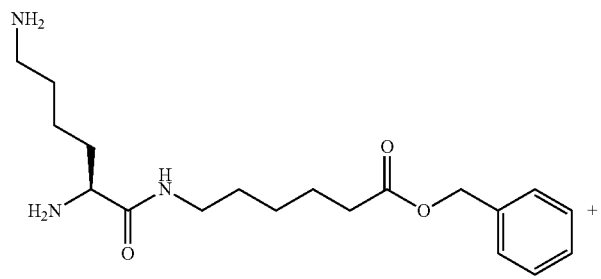

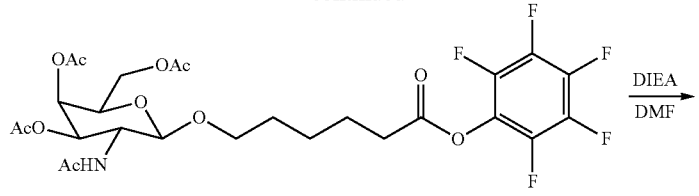

166

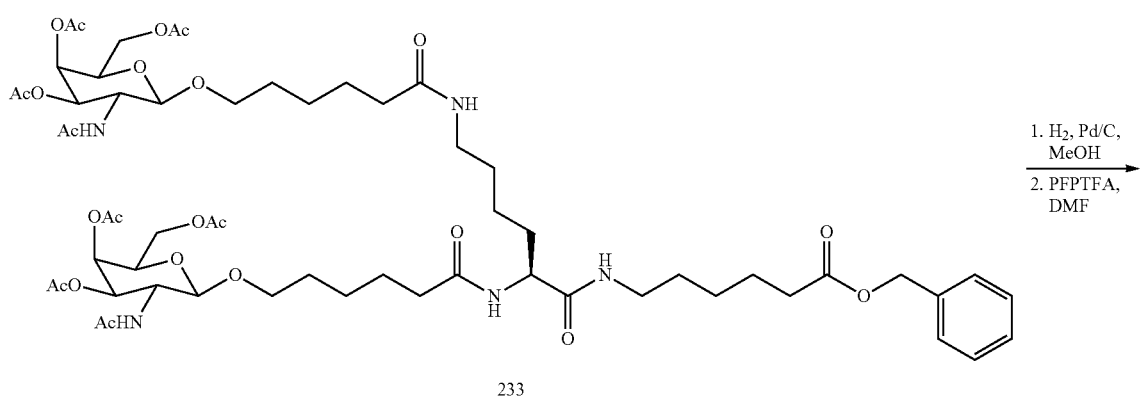

233

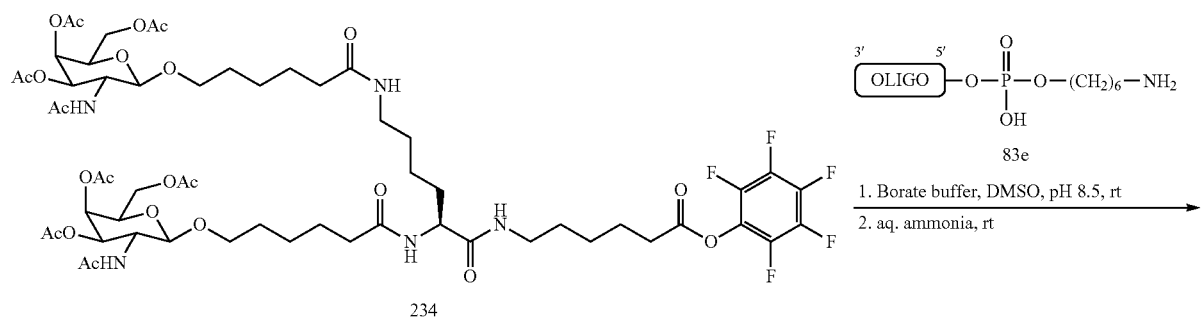

234

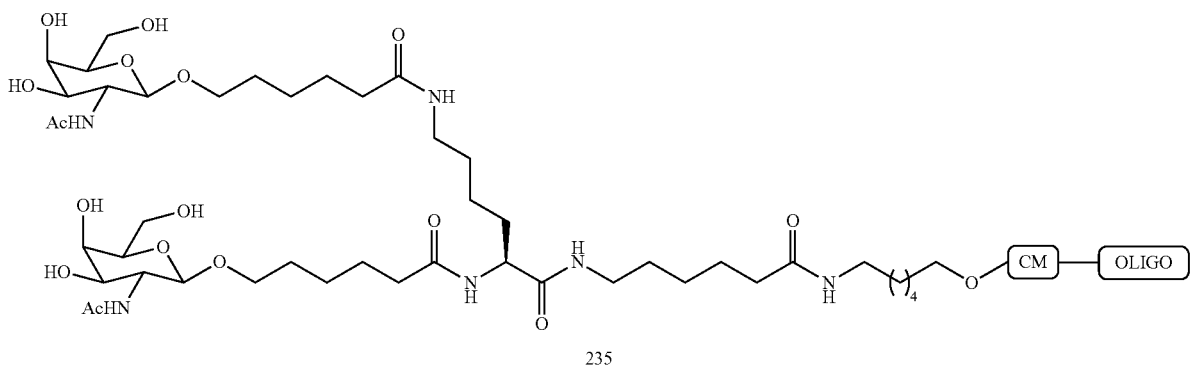

235

Compound 120 is commercially available, and the synthesis of compound 126 is described in Example 49. Compound 120 (1 g, 2.89 mmol), HBTU (0.39 g, 2.89 mmol), and HOBt (1.64 g, 4.33 mmol) were dissolved in DMF (10 mL and N,N-diisopropylethylamine (1.75 mL, 10.1 mmol) were added. After about 5 min, aminohexanoic acid benzyl ester (1.36 g, 3.46 mmol) was added to the reaction. After 3 h, the reaction mixture was poured into 100 mL of 1 M NaHSO4 and extracted with 2×50 mL ethyl acetate. Organic layers were combined and washed with 3×40 mL sat NaHCO$_3$ and 2× brine, dried with Na$_2$SO$_4$, filtered and concentrated. The product was purified by silica gel column chromatography (DCM:EA:Hex, 1:1:1) to yield compound 231. LCMS and NMR were consistent with the structure. Compounds 231

(1.34 g, 2.438 mmol) was dissolved in dichloromethane (10 mL) and trifluoracetic acid (10 mL) was added. After stirring at room temperature for 2 h, the reaction mixture was concentrated under reduced pressure and co-evaporated with toluene (3×10 mL). The residue was dried under reduced pressure to yield compound 232 as the trifuloracetate salt. The synthesis of compound 166 is described in Example 54. Compound 166 (3.39 g, 5.40 mmol) was dissolved in DMF (3 mL). A solution of compound 232 (1.3 g, 2.25 mmol) was dissolved in DMF (3 mL) and N,N-diisopropylethylamine (1.55 mL) was added. The reaction was stirred at room temperature for 30 minutes, then poured into water (80 mL) and the aqueous layer was extracted with EtOAc (2×100 mL). The organic phase was separated and washed with sat. aqueous NaHCO$_3$ (3×80 mL), 1 M NaHSO$_4$ (3×80 mL) and brine (2×80 mL), then dried (Na$_2$SO$_4$), filtered, and concentrated. The residue was purified by silica gel column chromatography to yield compound 233. LCMS and NMR were consistent with the structure. Compound 233 (0.59 g, 0.48 mmol) was dissolved in methanol (2.2 mL) and ethyl acetate (2.2 mL). Palladium on carbon (10 wt % Pd/C, wet, 0.07 g) was added, and the reaction mixture was stirred under hydrogen atmosphere for 3 h. The reaction mixture was filtered through a pad of Celite and concentrated to yield the carboxylic acid. The carboxylic acid (1.32 g, 1.15 mmol, cluster free acid) was dissolved in DMF (3.2 mL). To this N,N-diisopropylehtylamine (0.3 mL, 1.73 mmol) and PFPTFA (0.30 mL, 1.73 mmol) were added. After 30 min stirring at room temperature the reaction mixture was poured into water (40 mL) and extracted with EtOAc (2×50 mL). A standard work-up was completed as described above to yield compound 234. LCMS and NMR were consistent with the structure. Oligonucleotide 235 was prepared using the general procedure described in Example 46. The GalNAc$_2$ cluster portion (GalNAc$_2$-24$_a$) of the conjugate group GalNAc$_2$-24 can be combined with any cleavable moiety present on the oligonucleotide to provide a variety of conjugate groups. The structure of GalNAc$_2$-24 (GalNAc$_2$-24$_a$-CM) is shown below:

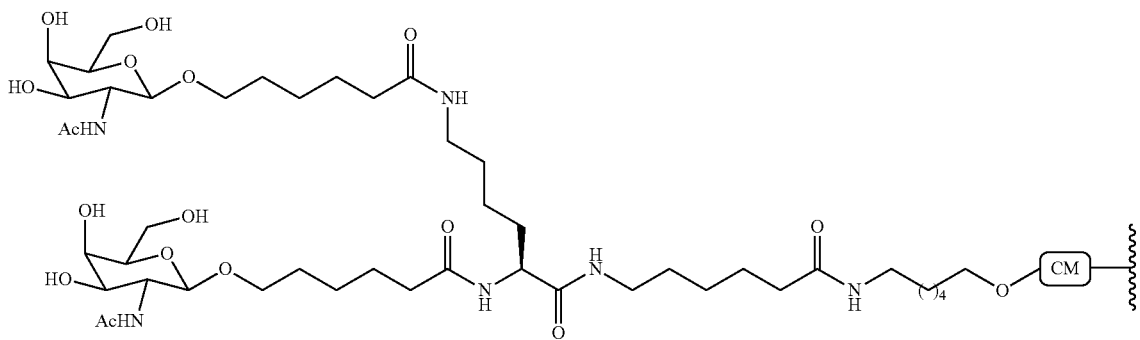

35

Example 105

Synthesis of Oligonucleotides Comprising a GalNAc$_1$-25 Conjugate

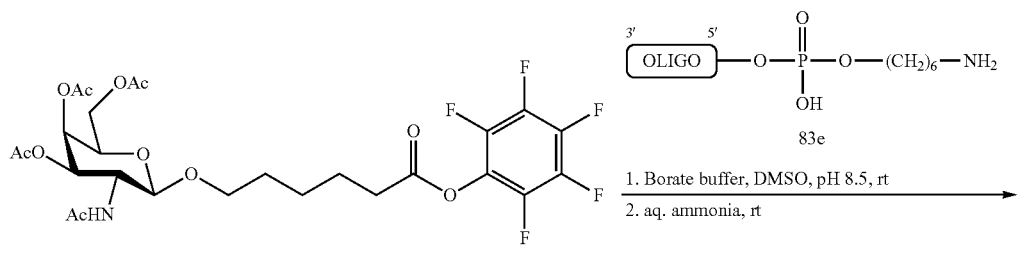

166

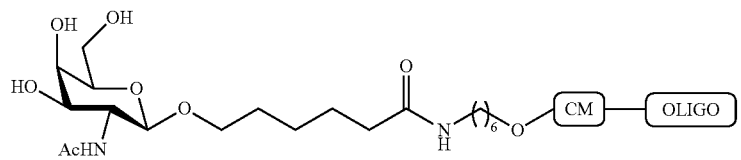

236

The synthesis of compound 166 is described in Example 54. Oligonucleotide 236 was prepared using the general procedure described in Example 46.

Alternatively, oligonucleotide 236 was synthesized using the scheme shown below, and compound 238 was used to form the oligonucleotide 236 using procedures described in Example 10.

Treatment

Six to week old, male C57BL/6 mice (Jackson Laboratory, Bar Harbor, Me.) were injected subcutaneously once with 2, 7, or 20 mg/kg of ISIS No. 440762; or with 0.2, 0.6, 2, 6, or 20 mg/kg of ISIS No. 686221, 686222, or 708561; or with saline. Each treatment group consisted of 4 animals. The mice were sacrificed 72 hours following the final administration. Liver SRB-1 mRNA levels were measured using real-time PCR.

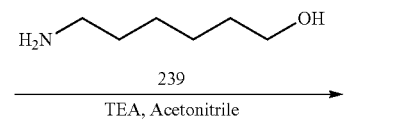

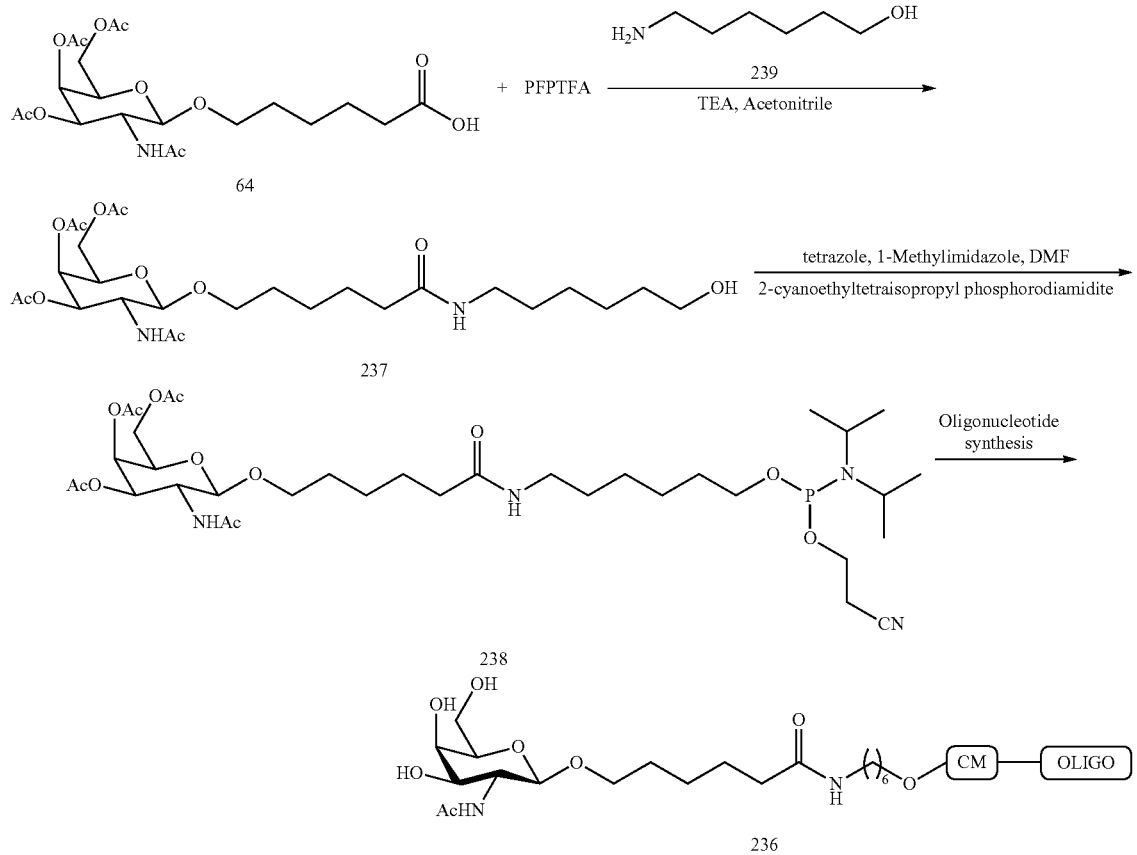

SRB-1 mRNA levels were normalized to cyclophilin mRNA levels according to standard protocols. The antisense oligonucleotides lowered SRB-1 mRNA levels in a dose-dependent manner, and the $ED_{50}$ results are presented in Tables 116 and 117. Although previous studies showed that trivalent GalNAc-conjugated oligonucleotides were significantly more potent than divalent GalNAc-conjugated oligonucleotides, which were in turn significantly more potent than monovalent GalNAc conjugated oligonucleotides (see, e.g., Khorev et al., *Bioorg. & Med. Chem.*, Vol. 16, 5216-5231 (2008)), treatment with antisense oligonucleotides comprising monovalent, divalent, and trivalent GalNAc clusters lowered SRB-1 mRNA levels with similar potencies as shown in Tables 116 and 117.

The GalNAc$_1$ cluster portion (GalNAc$_1$-25$_a$) of the conjugate group GalNAc$_1$-25 can be combined with any cleavable moiety present on the oligonucleotide to provide a variety of conjugate groups. The structure of GalNAc$_1$-25 (GalNAc$_1$-25$_a$-CM) is shown below:

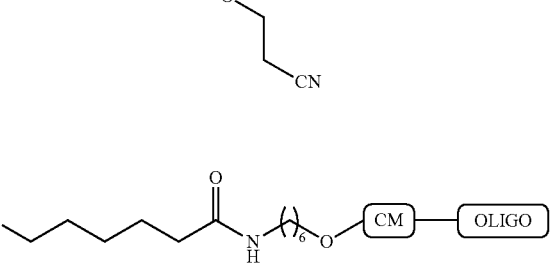

Example 106

Antisense Inhibition In Vivo by Oligonucleotides Targeting SRB-1 Comprising a 5% GalNAc$_2$ or a 5'-GalNAc$_3$ Conjugate Oligonucleotides listed in Tables 116 and 117 were tested in dose-dependent studies for antisense inhibition of SRB-1 in mice.

TABLE 116

Modified oligonucleotides targeting SRB-1

| ISIS No. | Sequences (5' to 3') | GalNAc Cluster | $ED_{50}$ (mg/kg) | SEQ ID No |
|---|---|---|---|---|
| 440762 | $T_{ks}{}^mC_{ks}A_{ds}G_{ds}T_{ds}{}^mC_{ds}A_{ds}$ $T_{ds}G_{ds}A_{ds}{}^mC_{ds}T_{as}T_{ks}{}^mC_k$ | n/a | 4.7 | 4880 |

TABLE 116-continued

Modified oligonucleotides targeting SRB-1

| ISIS No. | Sequences (5' to 3') | GalNAc Cluster | $ED_{50}$ (mg/kg) | SEQ ID No |
|---|---|---|---|---|
| 686221 | GalNAc$_2$-24$_{a\text{-}o}$A$_{do}$T$_{ks}$$^m$C$_{ks}$GalNAc$_2$-24$_a$ A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{ks}$$^m$C$_k$ | | 0.39 | 4884 |
| 686222 | GalNAc$_3$-13$_{a\text{-}o}$A$_{do}$T$_{ks}$$^m$C$_{ks}$GalNAc$_3$-13$_a$ A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{ks}$$^m$C$_k$ | | 0.41 | 4884 |

See Example 93 for table legend. The structure of GalNAc$_3$-13a was shown in Example 62, and the structure of GalNAc$_2$-24a was shown in Example 104.

TABLE 117

Modified oligonucleotides targeting SRB-1

| ISIS No. | Sequences (5' to 3') | GalNAc Cluster | $ED_{50}$ (mg/kg) | SEQ ID No |
|---|---|---|---|---|
| 440762 | T$_{ks}$$^m$C$_{ks}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{ks}$$^m$C$_k$ | n/a | 5 | 4880 |
| 708561 | GalNAc$_1$-25$_{a\text{-}o}$T$_{ks}$$^m$C$_{ks}$ A$_{ds}$G$_{ds}$T$_{ds}$$^m$C$_{ds}$A$_{ds}$T$_{ds}$G$_{ds}$ A$_{ds}$$^m$C$_{ds}$T$_{ds}$T$_{ks}$$^m$C$_k$ | GalNAc$_1$-25$_a$ | 0.4 | 4880 |

See Example 93 for table legend. The structure of GalNAc$_1$-25a was shown in Example 105.

The concentrations of the oligonucleotides in Tables 116 and 117 in liver were also assessed, using procedures described in Example 75. The results shown in Tables 117a and 117b below are the average total antisense oligonucleotide tissues levels for each treatment group, as measured by UV in units of μg oligonucleotide per gram of liver tissue. The results show that the oligonucleotides comprising a GalNAc conjugate group accumulated in the liver at significantly higher levels than the same dose of the oligonucleotide lacking a GalNAc conjugate group. Furthermore, the antisense oligonucleotides comprising one, two, or three GalNAc ligands in their respective conjugate groups all accumulated in the liver at similar levels. This result is surprising in view of the Khorev et al. literature reference cited above and is consistent with the activity data shown in Tables 116 and 117 above.

TABLE 117a

Liver concentrations of oligonucleotides comprising a GalNAc$_2$ or GalNAc$_3$ conjugate group

| ISIS No. | Dosage (mg/kg) | [Antisense oligonucleotide] (μg/g) | GalNAc cluster | CM |
|---|---|---|---|---|
| 440762 | 2 | 2.1 | n/a | n/a |
|  | 7 | 13.1 |  |  |
|  | 20 | 31.1 |  |  |
| 686221 | 0.2 | 0.9 | GalNAc$_2$-24$_a$ | A$_d$ |
|  | 0.6 | 2.7 |  |  |
|  | 2 | 12.0 |  |  |
|  | 6 | 26.5 |  |  |
| 686222 | 0.2 | 0.5 | GalNAc$_3$-13$_a$ | A$_d$ |
|  | 0.6 | 1.6 |  |  |
|  | 2 | 11.6 |  |  |
|  | 6 | 19.8 |  |  |

TABLE 117b

Liver concentrations of oligonucleotides comprising a GalNAc$_1$ conjugate group

| ISIS No. | Dosage (mg/kg) | [Antisense oligonucleotide] (μg/g) | GalNAc cluster | CM |
|---|---|---|---|---|
| 440762 | 2 | 2.3 | n/a | n/a |
|  | 7 | 8.9 |  |  |
|  | 20 | 23.7 |  |  |
| 708561 | 0.2 | 0.4 | GalNAc$_1$-25$_a$ | PO |
|  | 0.6 | 1.1 |  |  |
|  | 2 | 5.9 |  |  |
|  | 6 | 23.7 |  |  |
|  | 20 | 53.9 |  |  |

Example 107

Synthesis of Oligonucleotides Comprising a GalNAc$_1$-26 or GalNAc$_1$-27 Conjugate

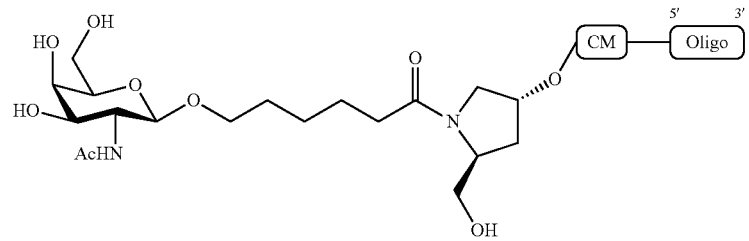

239

Oligonucleotide 239 is synthesized via coupling of compound 47 (see Example 15) to acid 64 (see Example 32) using HBTU and DIEA in DMF. The resulting amide containing compound is phosphitylated, then added to the 5'-end of an oligonucleotide using procedures described in Example 10. The GalNAc$_1$ cluster portion (GalNAc$_1$-26$_a$) of the conjugate group GalNAc$_1$-26 can be combined with any cleavable moiety present on the oligonucleotide to provide a variety of conjugate groups. The structure of GalNAc$_1$-26 (GalNAc$_1$-26$_a$-CM) is shown below:

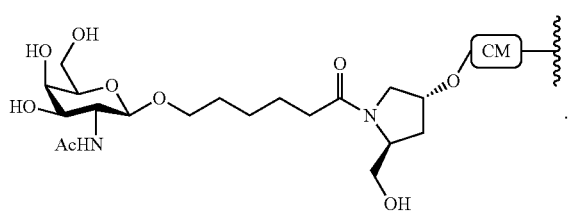

In order to add the GalNAc$_1$ conjugate group to the 3'-end of an oligonucleotide, the amide formed from the reaction of compounds 47 and 64 is added to a solid support using procedures described in Example 7. The oligonucleotide synthesis is then completed using procedures described in Example 9 in order to form oligonucleotide 240.

240

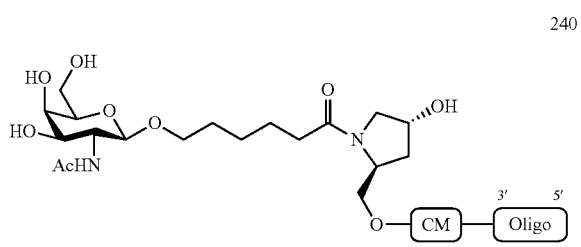

The GalNAc$_1$ cluster portion (GalNAc$_1$-27$_a$) of the conjugate group GalNAc$_1$-27 can be combined with any cleavable moiety present on the oligonucleotide to provide a variety of conjugate groups. The structure of GalNAc$_1$-27 (GalNAc$_1$-27$_a$-CM) is shown below:

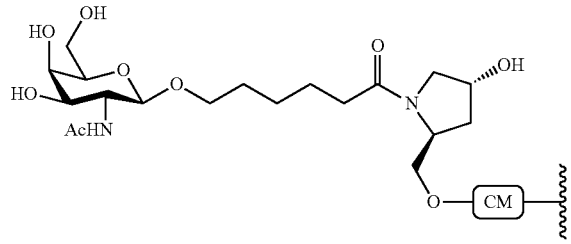

Example 108

Antisense Inhibition In Vivo by Oligonucleotides Comprising a GalNAc Conjugate Group Targeting Apo(a) In Vivo The oligonucleotides listed in Table 118 below were tested in a single dose study in mice.

TABLE 118

Modified ASOs targeting APO(a)

| ISIS No. | Sequences (5' to 3') | GalNAc$_3$ Cluster | CM | SEQ ID No. |
|---|---|---|---|---|
| 494372 | T$_{es}$G$_{es}$$^m$C$_{es}$T$_{es}$$^m$C$_{es}$$^m$C$_{ds}$G$_{ds}$ T$_{ds}$T$_{ds}$G$_{ds}$G$_{ds}$T$_{ds}$G$_{ds}$$^m$C$_{ds}$T$_{ds}$ T$_{es}$G$_{es}$T$_{es}$T$_{es}$$^m$C$_e$ | n/a | n/a | 4903 |
| 681251 | GalNAC$_3$-7$_{a-o'}$T$_{es}$G$_{es}$$^m$C$_{es}$ T$_{es}$$^m$C$_{es}$$^m$C$_{ds}$G$_{ds}$T$_{ds}$T$_{ds}$G$_{ds}$G$_{ds}$ T$_{ds}$G$_{ds}$$^m$C$_{ds}$T$_{ds}$T$_{es}$G$_{es}$T$_{es}$T$_{es}$$^m$C$_e$ | GalNAc$_3$-7a | PO | 4903 |

TABLE 118-continued

Modified ASOs targeting APO(a)

| ISIS No. | Sequences (5' to 3') | GalNAc$_3$ Cluster | CM | SEQ ID No. |
|---|---|---|---|---|
| 681255 | GalNAc$_3$-3$_{a-o'}$T$_{es}$G$_{eo}$$^m$C$_{eo}$ T$_{eo}$$^m$C$_{eo}$$^m$C$_{ds}$G$_{ds}$T$_{ds}$T$_{ds}$G$_{ds}$G$_{ds}$ T$_{ds}$G$_{ds}$$^m$C$_{ds}$T$_{ds}$T$_{eo}$G$_{eo}$T$_{es}$T$_{es}$$^m$C$_e$ | GalNAc$_3$-3a | PO | 4903 |
| 681256 | GalNAc$_3$-10$_{a-o'}$T$_{es}$G$_{eo}$$^m$C$_{eo}$T$_{eo}$ $^m$C$_{eo}$$^m$C$_{ds}$G$_{ds}$T$_{ds}$T$_{ds}$G$_{ds}$G$_{ds}$T$_{ds}$ G$_{ds}$$^m$C$_{ds}$T$_{ds}$T$_{eo}$G$_{eo}$T$_{es}$T$_{es}$$^m$C$_e$ | GalNAc$_3$-10a | PO | 4903 |
| 681257 | GalNAc$_3$-7$_{a-o'}$T$_{es}$G$_{eo}$$^m$C$_{eo}$T$_{eo}$ $^m$C$_{eo}$$^m$C$_{ds}$G$_{ds}$T$_{ds}$T$_{ds}$G$_{ds}$G$_{ds}$T$_{ds}$ G$_{ds}$$^m$C$_{ds}$T$_{ds}$T$_{eo}$G$_{eo}$T$_{es}$T$_{es}$$^m$C$_e$ | GalNAc$_3$-7a | PO | 4903 |
| 681258 | GalNAc$_3$-13$_{a-o'}$T$_{es}$G$_{eo}$$^m$C$_{eo}$T$_{eo}$ $^m$C$_{eo}$$^m$C$_{ds}$G$_{ds}$T$_{ds}$T$_{ds}$G$_{ds}$G$_{ds}$T$_{ds}$ G$_{ds}$$^m$C$_{ds}$T$_{ds}$T$_{eo}$G$_{eo}$T$_{es}$T$_{es}$$^m$C$_e$ | GalNAc$_3$-13a | PO | 4903 |
| 681260 | T$_{es}$G$_{eo}$$^m$C$_{eo}$T$_{eo}$$^m$C$_{eo}$$^m$C$_{ds}$G$_{ds}$ T$_{ds}$T$_{ds}$G$_{ds}$G$_{ds}$T$_{ds}$G$_{ds}$$^m$C$_{ds}$T$_{ds}$T$_{eo}$ G$_{eo}$T$_{es}$T$_{es}$$^m$C$_{eo}$A$_{do}$-GalNAc$_3$-19 | GalNAc$_3$-19a | A$_d$ | 4911 |

The structure of GalNAc$_3$-7$_a$ was shown in Example 48.

Treatment

Male transgenic mice that express human Apo(a) were each injected subcutaneously once with an oligonucleotide and dosage listed in Table 119 or with PBS. Each treatment group consisted of 4 animals. Blood was drawn the day before dosing to determine baseline levels of Apo(a) protein in plasma and at 1 week following the first dose. Additional blood draws will occur weekly for approximately 8 weeks. Plasma Apo(a) protein levels were measured using an ELISA. The results in Table 119 are presented as the average percent of plasma Apo(a) protein levels for each treatment group, normalized to baseline levels (% BL). The results show that the antisense oligonucleotides reduced Apo(a) protein expression. Furthermore, the oligonucleotides comprising a GalNAc conjugate group exhibited even more potent reduction in Apo(a) expression than the oligonucleotide that does not comprise a conjugate group.

TABLE 119

Apo(a) plasma protein levels

| ISIS No. | Dosage (mg/kg) | Apo(a) at 1 week (% BL) |
|---|---|---|
| PBS | n/a | 143 |
| 494372 | 50 | 58 |
| 681251 | 10 | 15 |
| 681255 | 10 | 14 |
| 681256 | 10 | 17 |
| 681257 | 10 | 24 |
| 681258 | 10 | 22 |
| 681260 | 10 | 26 |

Example 109

Synthesis of Oligonucleotides Comprising a GalNAc$_1$-28 or GalNAc$_1$-29 Conjugate

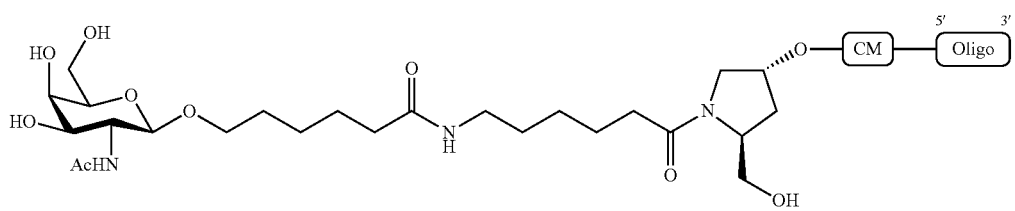

241

Oligonucleotide 241 is synthesized using procedures similar to those described in Example 71 to form the phosphoramidite intermediate, followed by procedures described in Example 10 to synthesize the oligonucleotide. The GalNAc$_1$ cluster portion (GalNAc$_1$-28$_a$) of the conjugate group GalNAc$_1$-28 can be combined with any cleavable moiety present on the oligonucleotide to provide a variety of conjugate groups. The structure of GalNAc$_1$-28 (GalNAc$_1$-28$_a$-CM) is shown below:

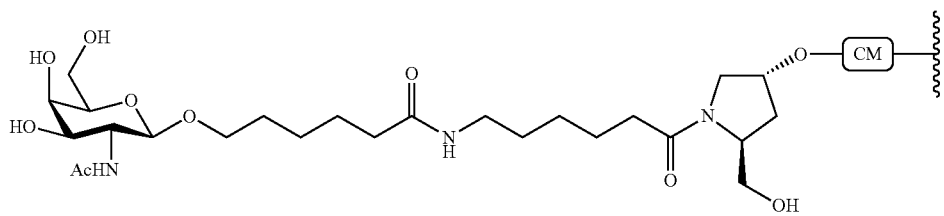

In order to add the GalNAc$_1$ conjugate group to the 3'-end of an oligonucleotide, procedures similar to those described in Example 71 are used to form the hydroxyl intermediate, which is then added to the solid support using procedures described in Example 7. The oligonucleotide synthesis is then completed using procedures described in Example 9 in order to form oligonucleotide 242.

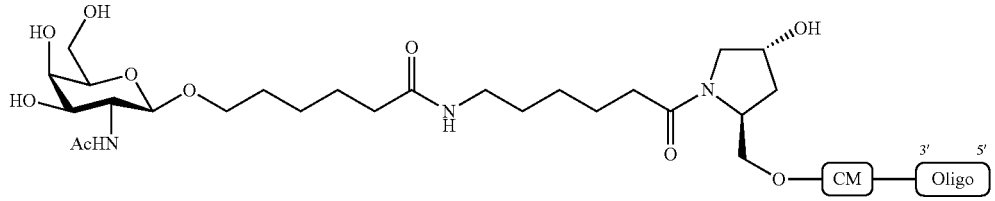

242

The GalNAc$_1$ cluster portion (GalNAc$_1$-29$_a$) of the conjugate group GalNAc$_1$-29 can be combined with any cleavable moiety present on the oligonucleotide to provide a variety of conjugate groups. The structure of GalNAc$_1$-29 (GalNAc$_1$-29$_a$-CM) is shown below:

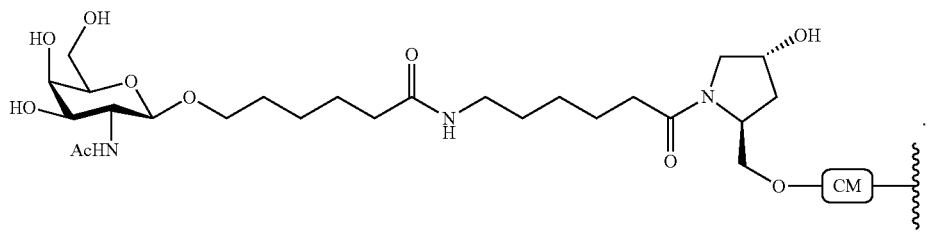

Example 110

Synthesis of Oligonucleotides Comprising a GalNAc$_1$-30 Conjugate

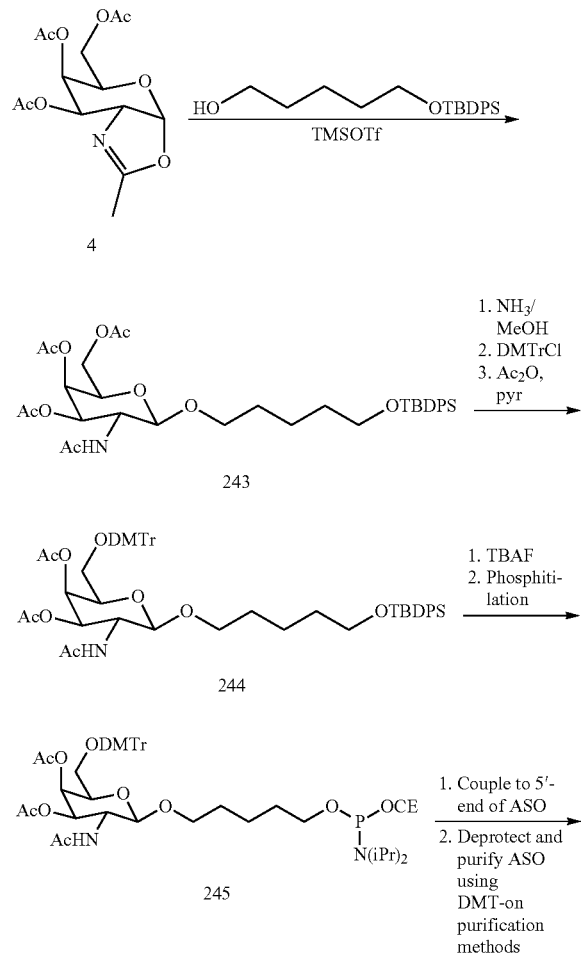

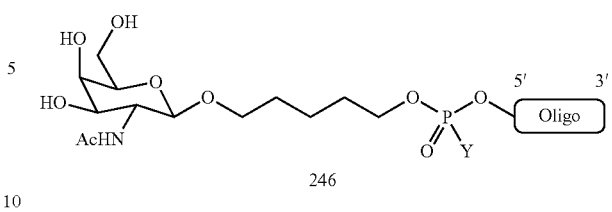

Oligonucleotide 246 comprising a GalNAc$_1$-30 conjugate group, wherein Y is selected from O, S, a substituted or unsubstituted C$_1$-C$_{10}$ alkyl, amino, substituted amino, azido, alkenyl or alkynyl, is synthesized as shown above. The GalNAc$_1$ cluster portion (GalNAc$_1$-30$_a$) of the conjugate group GalNAc$_1$-30 can be combined with any cleavable moiety to provide a variety of conjugate groups. In certain embodiments, Y is part of the cleavable moiety. In certain embodiments, Y is part of a stable moiety, and the cleavable moiety is present on the oligonucleotide. The structure of GalNAc$_1$-30$_a$ is shown below:

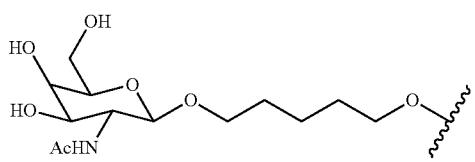 [SMILES: *OCCCCCOC1OC(CO)C(O)C(O)C1NC(C)=O]

Example 111

Synthesis of Oligonucleotides Comprising a GalNAc$_2$-31 or GalNAc$_2$-32 Conjugate

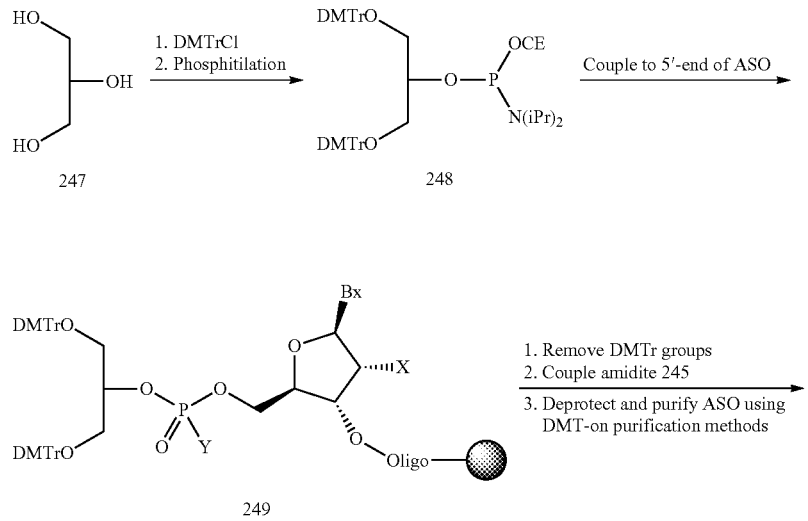

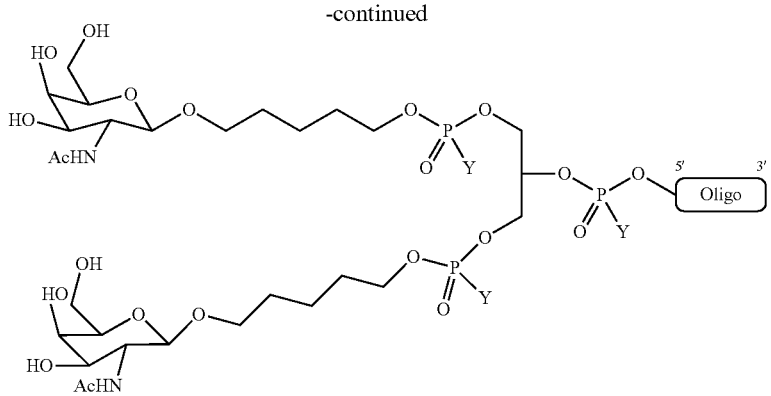

250

Oligonucleotide 250 comprising a GalNAc$_2$-31 conjugate group, wherein Y is selected from O, S, a substituted or unsubstituted $C_1$-$C_{10}$ alkyl, amino, substituted amino, azido, alkenyl or alkynyl, is synthesized as shown above. The GalNAc$_2$ cluster portion (GalNAc$_2$-31$_a$) of the conjugate group GalNAc$_2$-31 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-31$_a$ is shown below:

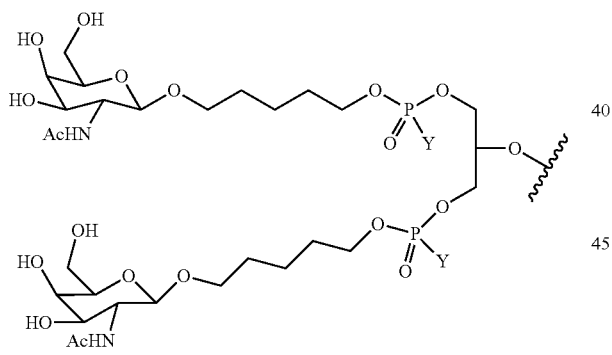

The synthesis of an oligonucleotide comprising a GalNAc$_2$-32 conjugate is shown below.

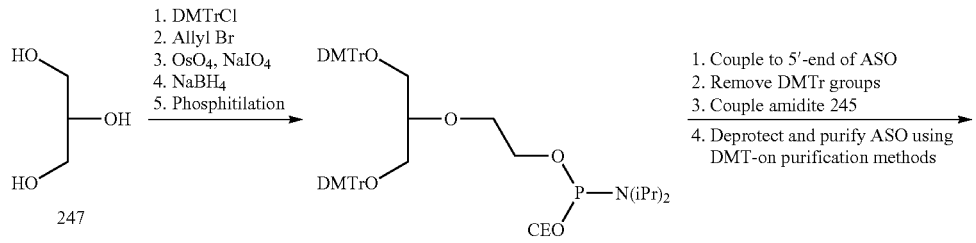

251

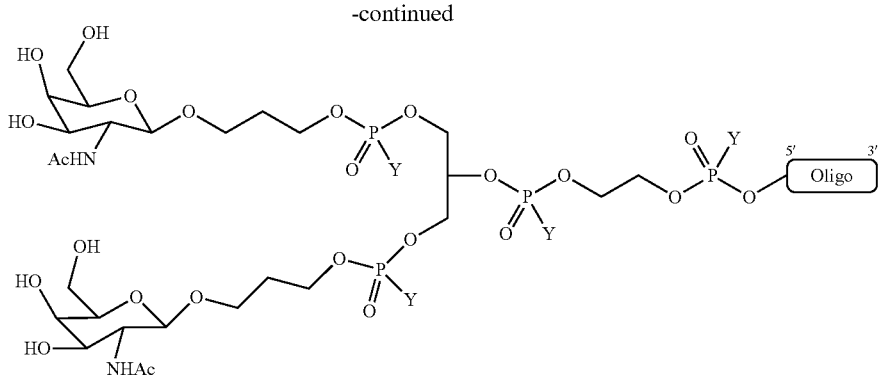

252

Oligonucleotide 252 comprising a GalNAc$_2$-32 conjugate group, wherein Y is selected from O, S, a substituted or unsubstituted C$_1$-C$_{10}$ alkyl, amino, substituted amino, azido, alkenyl or alkynyl, is synthesized as shown above. The Gal-NAc$_2$ cluster portion (GalNAc$_2$-32$_a$) of the conjugate group GalNAc$_2$-32 can be combined with any cleavable moiety to provide a variety of conjugate groups. In certain embodiments, the Y-containing group directly adjacent to the 5'-end of the oligonucleotide is part of the cleavable moiety. In certain embodiments, the Y-containing group directly adjacent to the 5'-end of the oligonucleotide is part of a stable moiety, and the cleavable moiety is present on the oligonucleotide. The structure of GalNAc$_2$-32$_a$ is shown below:

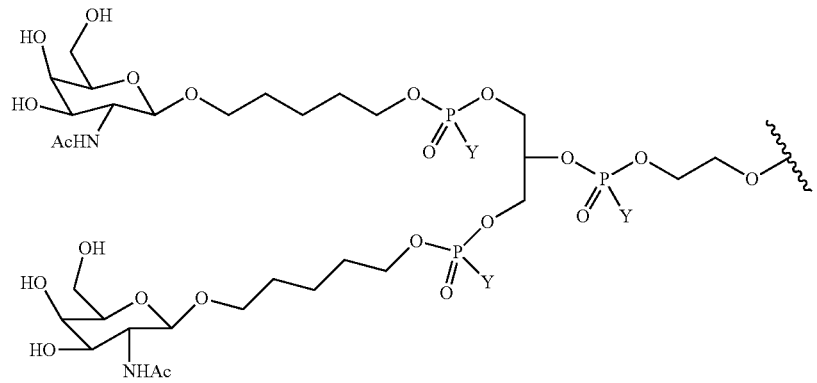

Example 112

Modified Oligonucleotides Comprising a GalNAc$_1$ Conjugate

The oligonucleotides in Table 120 targeting SRB-1 were synthesized with a GalNAc$_1$ conjugate group in order to further test the potency of oligonucleotides comprising conjugate groups that contain one GalNAc ligand.

TABLE 120

| ISIS No. | Sequence (5' to 3') | GalNAc cluster | CM | SEQ ID NO. |
|---|---|---|---|---|
| 711461 | GalNAc$_1$-25$_{a\text{-}o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$25$_a$ T$_{ds}$G$_{ds}$A$_{ds}$$^m$C$_{ds}$T$_{ds}$T$_{es}$$^m$C$_{es}$ $^m$C$_{es}$T$_{es}$T$_e$ | GalNAc$_1$- | A$_d$ | 4888 |
| 711462 | GalNAc$_1$-25$_{a\text{-}o'}$G$_{es}$$^m$C$_{es}$T$_{es}$ T$_{es}$$^m$C$_{es}$A$_{ds}$G$_{ds}$T$_{ds}$$^m$C$_{ds}$A$_{ds}$T$_{ds}$25$_a$ G$_{ds}$A$_{ds}$$^m$C$_{ds}$T$_{ds}$T$_{es}$$^m$C$_{es}$$^m$C$_{es}$ T$_{es}$T$_e$ | GalNAc$_1$- | PO | 4886 |
| 711463 | GalNAc$_1$-25$_{a\text{-}o'}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$25$_a$ G$_{ds}$A$_{ds}$$^m$C$_{ds}$T$_{ds}$T$_{eo}$$^m$C$_{eo}$$^m$C$_{es}$ T$_{es}$T$_e$ | GalNAc$_1$- | PO | 4886 |
| 711465 | GalNAc$_1$-26$_{a\text{-}o'}$A$_{do}$G$_{es}$$^m$C$_{es}$ T$_{es}$T$_{es}$$^m$C$_{es}$A$_{ds}$G$_{ds}$T$_{ds}$$^m$C$_{ds}$A$_{ds}$26$_a$ T$_{ds}$G$_{ds}$A$_{ds}$$^m$C$_{ds}$T$_{ds}$T$_{es}$$^m$C$_{es}$ $^m$C$_{es}$T$_{es}$T$_e$ | GalNAc$_1$- | A$_d$ | 4888 |
| 711466 | GalNAc$_1$-26$_{a\text{-}o'}$G$_{es}$$^m$C$_{es}$T$_{es}$ T$_{es}$$^m$C$_{es}$A$_{ds}$G$_{ds}$T$_{ds}$$^m$C$_{ds}$A$_{ds}$T$_{ds}$26$_a$ G$_{ds}$A$_{ds}$$^m$C$_{ds}$T$_{ds}$T$_{es}$$^m$C$_{es}$$^m$C$_{es}$ T$_{es}$T$_e$ | GalNAc$_1$- | PO | 4886 |
| 711467 | GalNAc$_1$-26$_{a\text{-}o'}$G$_{es}$$^m$C$_{eo}$T$_{eo}$ T$_{eo}$$^m$C$_{eo}$A$_{ds}$G$_{ds}$T$_{ds}$$^m$C$_{ds}$A$_{ds}$T$_{ds}$26$_a$ G$_{ds}$A$_{ds}$$^m$C$_{ds}$T$_{ds}$T$_{eo}$$^m$C$_{eo}$$^m$C$_{es}$ T$_{es}$T$_e$ | GalNAc$_1$- | PO | 4886 |

TABLE 120-continued

| ISIS No. | Sequence (5' to 3') | GalNAc cluster | CM | SEQ ID NO. |
|---|---|---|---|---|
| 711468 | GalNAc$_1$-28$_{a-o'}$A$_{do}$G$_{es}$$^m$C$_{es}$T$_{es}$T$_{es}$$^m$C$_{es}$A$_{ds}$G$_{ds}$T$_{ds}$$^m$C$_{ds}$A$_{ds}$28$_a$ T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_1$-28$_a$ | A$_d$ | 4888 |
| 711469 | GalNAc$_1$-28$_{a-o'}$G$_{es}$$^m$C$_{es}$T$_{es}$T$_{es}$$^m$C$_{es}$A$_{ds}$G$_{ds}$T$_{ds}$$^m$C$_{ds}$A$_{ds}$ T$_{ds}$G$_{ds}$A$_{ds}$$^m$C$_{ds}$T$_{ds}$T$_{es}$$^m$C$_{es}$$^m$C$_{es}$T$_{es}$T$_e$ | GalNAc$_1$-28$_a$ | PO | 4886 |
| 711470 | GalNAc$_1$-28$_{a-o'}$G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$28$_a$ G$_{ds}$A$_{ds}$$^m$C$_{ds}$T$_{ds}$T$_{eo}$$^m$C$_{eo}$$^m$C$_{es}$T$_{es}$T$_e$ | GalNAc$_1$-28$_a$ | PO | 4886 |
| 713844 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$27$_a$ $^m$C$_{es}$$^m$C$_{es}$T$_{es}$T$_{eo'}$-GalNAc$_1$-27$_a$ | GalNAc$_1$-27$_a$ | PO | 4886 |
| 713845 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$27$_a$ $^m$C$_{eo}$$^m$C$_{es}$T$_{es}$T$_{eo'}$-GalNAc$_1$-27$_a$ | GalNAc$_1$-27$_a$ | PO | 4886 |
| 713846 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$27$_a$ $^m$C$_{eo}$$^m$C$_{es}$T$_{es}$T$_{eo}$A$_{do'}$-GalNAc$_1$-27$_a$ | GalNAc$_1$-27$_a$ | A$_d$ | 4887 |
| 713847 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$29$_a$ $^m$C$_{es}$$^m$C$_{es}$T$_{es}$T$_{eo'}$-GalNAc$_1$-29$_a$ | GalNAc$_1$-29$_a$ | PO | 4886 |
| 713848 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$29a $^m$C$_{eo}$$^m$C$_{es}$T$_{es}$T$_{eo'}$-GalNAc$_1$-29$_a$ | GalNAc$_1$-29$_a$ | PO | 4886 |
| 713849 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$29$_a$ $^m$C$_{es}$$^m$C$_{es}$T$_{es}$T$_{eo}$A$_{do'}$-GalNAc$_1$-29$_a$ | GalNAc$_1$-29$_a$ | A$_d$ | 4887 |
| 713850 | G$_{es}$$^m$C$_{eo}$T$_{eo}$T$_{eo}$$^m$C$_{eo}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{eo}$29$_a$ $^m$C$_{eo}$$^m$C$_{es}$T$_{es}$T$_{eo}$A$_{do'}$-GalNAc$_1$-29$_a$ | GalNAc$_1$-29$_a$ | A$_d$ | 4887 |

Example 113

Antisense Oligonucleotides Targeting Angiopoietin-Like 3 and Comprising a GalNAc Conjugate Group The oligonucleotides in Table 121 were designed to target human angiopoietin-like 3 (ANGPTL3).

TABLE 121

| ISIS No. | Sequences (5' to 3') | SEQ ID No. |
|---|---|---|
| 563580 (parent) | G$_{es}$G$_{es}$A$_{es}$$^m$C$_{es}$A$_{es}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{es}$$^m$C$_{es}$G$_{es}$$^m$C$_{es}$A$_e$ | 77 |
| 658501 | G$_{es}$G$_{es}$A$_{es}$$^m$C$_{es}$A$_{es}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{es}$$^m$C$_{es}$G$_{es}$$^m$C$_{es}$A$_{eo}$A$_{do'}$-GalNAc$_3$-1$_a$ | 4912 |
| 666944 | GalNAc$_3$-3$_{a-o'}$A$_{do}$G$_{es}$G$_{es}$A$_{es}$$^m$C$_{es}$A$_{es}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{es}$$^m$C$_{es}$G$_{es}$$^m$C$_{es}$A$_e$ | 4913 |
| 666945 | G$_{es}$G$_{eo}$A$_{eo}$$^m$C$_{eo}$A$_{eo}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{eo}$$^m$C$_{eo}$G$_{es}$$^m$C$_{es}$A$_{eo}$A$_{do'}$-GalNAc$_3$-1$_a$ | 4912 |
| 666946 | GalNAc$_3$-3$_{a-o'}$A$_{do}$G$_{es}$G$_{eo}$A$_{eo}$$^m$C$_{eo}$A$_{eo}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{eo}$$^m$C$_{eo}$G$_{es}$$^m$C$_{es}$A$_e$ | 4913 |
| 703801 | GalNAc$_3$-7$_{a-o'}$G$_{es}$G$_{es}$A$_{es}$$^m$C$_{es}$A$_{es}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{es}$$^m$C$_{es}$G$_{es}$$^m$C$_{es}$A$_e$ | 77 |
| 703802 | GalNAc$_3$-7$_{a-o'}$G$_{es}$G$_{eo}$A$_{eo}$$^m$C$_{eo}$A$_{eo}$T$_{ds}$T$_{ds}$G$_{ds}$$^m$C$_{ds}$$^m$C$_{ds}$A$_{ds}$G$_{ds}$T$_{ds}$A$_{ds}$A$_{ds}$T$_{eo}$$^m$C$_{eo}$G$_{es}$$^m$C$_{es}$A$_e$ | 77 |

Example 114

Antisense Inhibition In Vivo by Oligonucleotides Comprising a GalNAc Conjugate Group Targeting Human ANGPTL3

Six week old male, transgenic C57B1/6 mice that express human ANGPTL3 were each injected intraperitoneally once per week at a dosage shown below, for a total of two doses, with an oligonucleotide listed in Table 122 (and described in Table 121) or with PBS. Each treatment group consisted of 4 animals. The mice were sacrificed two days following the final dose. ANGPTL3 liver mRNA levels were measured using real-time PCR and RIBOGREEN® RNA quantification reagent (Molecular Probes, Inc. Eugene, Oreg.) according to standard protocols. The results below are presented as the average percent of ANGPTL3 mRNA levels in liver for each treatment group, normalized to the PBS control.

As illustrated in Table 122, treatment with antisense oligonucleotides lowered ANGPTL3 liver mRNA levels in a dose-dependent manner, and the oligonucleotide comprising a GalNAc conjugate was significantly more potent than the parent oligonucleotide lacking a GalNAc conjugate.

TABLE 122

ANGPTL3 liver mRNA levels

| ISIS No. | Dosage (mg/kg) | mRNA (% PBS) | GalNAc$_3$ Cluster | CM |
|---|---|---|---|---|
| 563580 | 5 | 58 | n/a | n/a |
|  | 10 | 56 |  |  |
|  | 15 | 36 |  |  |
|  | 25 | 23 |  |  |
|  | 50 | 20 |  |  |
| 658501 | 0.3 | 78 | GalNAc$_3$-1$_a$ | A$_d$ |
|  | 1 | 60 |  |  |
|  | 3 | 27 |  |  |
|  | 10 | 19 |  |  |

Liver alanine aminotransferase (ALT) levels were also measured at time of sacrifice using standard protocols. The results are showed that none of the treatment groups had elevated ALT levels, indicating that the oligonucleotides were well tolerated.

Example 115

Antisense Inhibition In Vivo by Oligonucleotides Comprising a GalNAc Conjugate Group Targeting Mouse ANGPTL3

The oligonucleotides listed in Table 123 below were tested in a dose-dependent study in mice.

TABLE 123

Modified ASOs targeting mouse ANGPTL3

| ISIS No. | Sequences (5' to 3') | GalNAc$_3$ Cluster | CM | SEQ ID No. |
|---|---|---|---|---|
| 233693 | G$_{es}$A$_{es}$$^m$C$_{es}$A$_{es}$T$_{es}$G$_{ds}$T$_{ds}$T$_{ds}$$^m$C$_{ds}$T$_{ds}$T$_{ds}$$^m$C$_{ds}$A$_{ds}$$^m$C$_{ds}$$^m$C$_{ds}$T$_{es}$$^m$C$_{es}$$^m$C$_{es}$T$_{es}$$^m$C$_e$ | n/a | n/a | 4914 |
| 703803 | GalNAc$_3$-7$_a$-$_o$G$_{es}$A$_{es}$$^m$C$_{es}$A$_{es}$T$_{es}$G$_{ds}$T$_{ds}$T$_{ds}$$^m$C$_{ds}$T$_{ds}$T$_{ds}$$^m$C$_{ds}$A$_{ds}$$^m$C$_{ds}$$^m$C$_{ds}$T$_{es}$$^m$C$_{es}$$^m$C$_{es}$T$_{es}$$^m$C$_e$ | GalNAc$_3$-7a | PO | 4914 |
| 703804 | GalNAc$_3$-7$_a$-$_o$G$_{es}$A$_{eo}$$^m$C$_{eo}$A$_{eo}$T$_{eo}$G$_{ds}$T$_{ds}$T$_{ds}$$^m$C$_{ds}$T$_{ds}$T$_{ds}$$^m$C$_{ds}$A$_{ds}$$^m$C$_{ds}$$^m$C$_{ds}$T$_{eo}$$^m$C$_{eo}$$^m$C$_{es}$T$_{es}$$^m$C$_e$ | GalNAc$_3$-7a | PO | 4914 |

The structure of GalNAc$_3$-7$_a$ was shown in Example 48.

Low density lipoprotein receptor knock-out (LDLR$^{-/-}$) mice were fed a western diet for 1 week before being injected intraperitoneally once per week at a dosage shown below with an oligonucleotide listed in Table 123 or with PBS. Each treatment group consisted of 5 animals. Blood was drawn before the first dose was administered in order to determine baseline levels of triglycerides in plasma and at 2 weeks following the first dose. The results in Table 124 are presented as the average percent of plasma triglyceride levels for each treatment group, normalized to baseline levels (% BL), The results show that the antisense oligonucleotides reduced triglycerides in a dose dependent manner. Furthermore, the oligonucleotides comprising a GalNAc conjugate group exhibited even more potent reduction in triglycerides than the oligonucleotide that does not comprise a conjugate group.

TABLE 124

Plasma triglyceride (TG) levels

| ISIS No. | Dosage (mg/kg) | TG (% BL) | ED$_{50}$ (mg/kg) | GalNAc$_3$ Cluster | CM |
|---|---|---|---|---|---|
| PBS | n/a | 110 | n/a | n/a | n/a |
| 233693 | 1 | 92 | 16 | n/a | n/a |
|  | 3 | 71 |  |  |  |
|  | 10 | 57 |  |  |  |
|  | 30 | 42 |  |  |  |
| 703803 | 0.3 | 96 | 2 | GalNAc$_3$-7a | PO |
|  | 1 | 69 |  |  |  |
|  | 3 | 39 |  |  |  |
|  | 10 | 27 |  |  |  |
| 703804 | 0.3 | 97 | 2 | GalNAc$_3$-7a | PO |
|  | 1 | 54 |  |  |  |
|  | 3 | 38 |  |  |  |
|  | 10 | 26 |  |  |  |

Example 116

Antisense Inhibition of Human Angiopoietin-Like 3 in Hep3B Cells by MOE Gapmers Antisense oligonucleotides were designed targeting an Angiopoietin-like 3 (ANGPTL3) nucleic acid and were tested for their effects on ANGPTL3 mRNA in vitro. The antisense oligonucleotides were tested in a series of experiments that had similar culture conditions. The results for each experiment are presented in separate tables shown below. Cultured Hep3B cells at a density of 20,000 cells per well were transfected using electroporation with 4,500 nM antisense oligonucleotide. After a treatment period of approximately 24 hours, RNA was isolated from the cells and ANGPTL3 mRNA levels were measured by quantitative real-time PCR. Human primer probe set RTS3492_MGB (forward sequence CCGTGGAAGACCAATATAAACAATT, designated herein as SEQ ID NO: 4; AGTCCTTCTGAGCTGATTTTCTATTTCT; reverse sequence, designated herein as SEQ ID NO: 5; probe sequence AACCAACAGCATAGTCAAATA, designated herein as SEQ ID NO: 6) was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as 5-10-5 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 125

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544059 | 23 | 42 | GATTTTCAATTTCAAGCAAC | 40 | 3127 | 3146 | 238 |
| 337459 | 49 | 68 | AGCTTAATTGTGAACATTTT | 47 | 3153 | 3172 | 239 |
| 544060 | 54 | 73 | GAAGGAGCTTAATTGTGAAC | 1 | 3158 | 3177 | 240 |
| 544061 | 63 | 82 | CAATAAAAAGAAGGAGCTTA | 37 | 3167 | 3186 | 241 |
| 544062 | 66 | 85 | GAACAATAAAAAGAAGGAGC | 38 | 3170 | 3189 | 242 |
| 544063 | 85 | 104 | CTGGAGGAAATAACTAGAGG | 30 | 3189 | 3208 | 243 |
| 337460 | 88 | 107 | ATTCTGGAGGAAATAACTAG | 39 | 3192 | 3211 | 244 |
| 544064 | 112 | 131 | TCAAATGATGAATTGTCTTG | 36 | 3216 | 3235 | 245 |
| 544065 | 138 | 157 | TTGATTTTGGCTCTGGAGAT | 26 | 3242 | 3261 | 246 |

TABLE 125-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544066 | 145 | 164 | GCAAATCTTGATTTTGGCTC | 56 | 3249 | 3268 | 247 |
| 233676 | 148 | 167 | ATAGCAAATCTTGATTTTGG | 69 | 3252 | 3271 | 248 |
| 544067 | 156 | 175 | CGTCTAACATAGCAAATCTT | 64 | 3260 | 3279 | 249 |
| 544068 | 174 | 193 | TGGCTAAAATTTTTACATCG | 28 | 3278 | 3297 | 250 |
| 544069 | 178 | 197 | CCATTGGCTAAAATTTTTAC | 0 | 3282 | 3301 | 251 |
| 544070 | 184 | 203 | AGGAGGCCATTGGCTAAAAT | 7 | 3288 | 3307 | 252 |
| 544071 | 187 | 206 | TGAAGGAGGCCATTGGCTAA | 32 | 3291 | 3310 | 253 |
| 544072 | 195 | 214 | GTCCCAACTGAAGGAGGCCA | 9 | 3299 | 3318 | 254 |
| 544073 | 199 | 218 | CCATGTCCCAACTGAAGGAG | 6 | 3303 | 3322 | 255 |
| 544074 | 202 | 221 | AGACCATGTCCCAACTGAAG | 18 | 3306 | 3325 | 256 |
| 544075 | 206 | 225 | TTTAAGACCATGTCCCAACT | 0 | 3310 | 3329 | 257 |
| 544076 | 209 | 228 | GTCTTTAAGACCATGTCCCA | 0 | 3313 | 3332 | 258 |
| 544077 | 216 | 235 | GGACAAAGTCTTTAAGACCA | 0 | 3320 | 3339 | 259 |
| 544078 | 222 | 241 | TCTTATGGACAAAGTCTTTA | 0 | 3326 | 3345 | 260 |
| 544079 | 245 | 264 | TATGTCATTAATTTGGCCCT | 0 | 3349 | 3368 | 261 |
| 544080 | 270 | 289 | GATCAAATATGTTGAGTTTT | 27 | 3374 | 3393 | 262 |
| 233690 | 274 | 293 | GACTGATCAAATATGTTGAG | 49 | 3378 | 3397 | 263 |
| 544081 | 316 | 335 | TCTTCTTTGATTTCACTGGT | 62 | 3420 | 3439 | 264 |
| 544082 | 334 | 353 | CTTCTCAGTTCCTTTTCTTC | 35 | 3438 | 3457 | 265 |
| 544083 | 337 | 356 | GTTCTTCTCAGTTCCTTTTC | 60 | 3441 | 3460 | 266 |
| 544084 | 341 | 360 | TGTAGTTCTTCTCAGTTCCT | 51 | 3445 | 3464 | 267 |
| 544431 | 345 | 364 | TATATGTAGTTCTTCTCAGT | 9 | 3449 | 3468 | 268 |
| 544086 | 348 | 367 | GTTTATATGTAGTTCTTCTC | 39 | 3452 | 3471 | 269 |
| 544087 | 352 | 371 | TGTAGTTTATATGTAGTTCT | 30 | 3456 | 3475 | 270 |
| 544088 | 356 | 375 | GACTTGTAGTTTATATGTAG | 12 | 3460 | 3479 | 271 |
| 544089 | 364 | 383 | TCATTTTTGACTTGTAGTTT | 31 | 3468 | 3487 | 272 |
| 544090 | 369 | 388 | CCTCTTCATTTTTGACTTGT | 61 | 3473 | 3492 | 273 |
| 544091 | 375 | 394 | TCTTTACCTCTTCATTTTTG | 48 | 3479 | 3498 | 274 |
| 544092 | 380 | 399 | CATATTCTTTACCTCTTCAT | 35 | 3484 | 3503 | 275 |
| 544093 | 384 | 403 | GTGACATATTCTTTACCTCT | 63 | 3488 | 3507 | 276 |
| 544094 | 392 | 411 | GAGTTCAAGTGACATATTCT | 53 | 3496 | 3515 | 277 |
| 544095 | 398 | 417 | TGAGTTGAGTTCAAGTGACA | 31 | 3502 | 3521 | 278 |
| 544096 | 403 | 422 | AGTTTTGAGTTGAGTTCAAG | 14 | 3507 | 3526 | 279 |
| 544097 | 406 | 425 | TCAAGTTTTGAGTTGAGTTC | 38 | 3510 | 3529 | 280 |
| 544098 | 414 | 433 | GGAGGCTTTCAAGTTTTGAG | 39 | 3518 | 3537 | 281 |
| 544099 | 423 | 442 | TTTCTTCTAGGAGGCTTTCA | 57 | 3527 | 3546 | 282 |
| 544100 | 427 | 446 | ATTTTTTCTTCTAGGAGGCT | 39 | 3531 | 3550 | 283 |
| 544101 | 432 | 451 | GTAGAATTTTTTCTTCTAGG | 28 | 3536 | 3555 | 284 |
| 544102 | 462 | 481 | GCTCTTCTAAATATTTCACT | 60 | 3566 | 3585 | 285 |
| 544103 | 474 | 493 | AGTTAGTTAGTTGCTCTTCT | 40 | 3578 | 3597 | 286 |
| 544104 | 492 | 511 | CAGGTTGATTTTGAATTAAG | 38 | 3596 | 3615 | 287 |
| 544105 | 495 | 514 | TTTCAGGTTGATTTTGAATT | 28 | 3599 | 3618 | 288 |
| 544106 | 499 | 518 | GGAGTTTCAGGTTGATTTTG | 38 | 3603 | 3622 | 289 |
| 544107 | 504 | 523 | GTTCTGGAGTTTCAGGTTGA | 50 | 3608 | 3627 | 290 |
| 544108 | 526 | 545 | TTAAGTGAAGTTACTTCTGG | 20 | 3630 | 3649 | 291 |
| 544109 | 555 | 574 | TGCTATTATCTTGTTTTTCT | 23 | 4293 | 4312 | 292 |
| 544110 | 564 | 583 | GGTCTTTGATGCTATTATCT | 67 | 4302 | 4321 | 293 |
| 544111 | 567 | 586 | GAAGGTCTTTGATGCTATTA | 49 | 4305 | 4324 | 294 |
| 544112 | 572 | 591 | CTGGAGAAGGTCTTTGATGC | 52 | 4310 | 4329 | 295 |
| 544113 | 643 | 662 | CTGAGCTGATTTTCTATTTC | 12 | n/a | n/a | 296 |
| 337477 | 664 | 683 | GGTTCTTGAATACTAGTCCT | 70 | 6677 | 6696 | 234 |
| 544114 | 673 | 692 | ATTTCTGTGGGTTCTTGAAT | 32 | 6686 | 6705 | 297 |
| 337478 | 675 | 694 | AAATTTCTGTGGGTTCTTGA | 51 | 6688 | 6707 | 235 |
| 544115 | 678 | 697 | GAGAAATTTCTGTGGGTTCT | 54 | 6691 | 6710 | 298 |
| 544116 | 682 | 701 | GATAGAGAAATTTCTGTGGG | 25 | 6695 | 6714 | 299 |
| 544117 | 689 | 708 | CTTGGAAGATAGAGAAATTT | 16 | 6702 | 6721 | 300 |
| 337479 | 692 | 711 | TGGCTTGGAAGATAGAGAAA | 34 | 6705 | 6724 | 236 |
| 544118 | 699 | 718 | GTGCTCTTGGCTTGGAAGAT | 64 | 6712 | 6731 | 301 |
| 544119 | 703 | 722 | CTTGGTGCTCTTGGCTTGGA | 70 | 6716 | 6735 | 302 |
| 544120 | 707 | 726 | AGTTCTTGGTGCTCTTGGCT | 82 | 6720 | 6739 | 15 |
| 233710 | 710 | 729 | AGTAGTTCTTGGTGCTCTTG | 63 | 6723 | 6742 | 233 |
| 544121 | 713 | 732 | GGGAGTAGTTCTTGGTGCTC | 64 | 6726 | 6745 | 303 |
| 544122 | 722 | 741 | CTGAAGAAAGGGAGTAGTTC | 24 | 6735 | 6754 | 304 |
| 544123 | 752 | 771 | ATCATGTTTTACATTTCTTA | 0 | 6765 | 6784 | 305 |
| 544124 | 755 | 774 | GCCATCATGTTTTACATTTC | 35 | n/a | n/a | 306 |
| 544125 | 759 | 778 | GAATGCCATCATGTTTTACA | 8 | n/a | n/a | 307 |
| 544126 | 762 | 781 | CAGGAATGCCATCATGTTTT | 6 | n/a | n/a | 308 |
| 337487 | 804 | 823 | CACTTGTATGTTCACCTCTG | 65 | 7389 | 7408 | 28 |
| 233717 | 889 | 908 | TGAATTAATGTCCATGGACT | 33 | 7876 | 7895 | 14 |

TABLE 126

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544204 | n/a | n/a | GACTTCTTAACTCTATATAT | 0 | 3076 | 3095 | 309 |
| 544205 | n/a | n/a | CTAGACTTCTTAACTCTATA | 0 | 3079 | 3098 | 310 |
| 544206 | n/a | n/a | GACCTAGACTTCTTAACTCT | 0 | 3082 | 3101 | 311 |
| 544207 | n/a | n/a | GGAAGCAGACCTAGACTTCT | 21 | 3089 | 3108 | 312 |
| 544208 | n/a | n/a | TCTGGAAGCAGACCTAGACT | 23 | 3092 | 3111 | 313 |
| 544209 | n/a | n/a | TCTTCTGGAAGCAGACCTAG | 7 | 3095 | 3114 | 314 |
| 544210 | n/a | n/a | CTAATCTTTAGGGATTTAGG | 24 | 11433 | 11452 | 315 |
| 544211 | n/a | n/a | TGTATCTAATCTTTAGGGAT | 2 | 11438 | 11457 | 316 |
| 544213 | n/a | n/a | TAACTTGGGCACTATATCCT | 44 | 11553 | 11572 | 317 |
| 544214 | n/a | n/a | ATTGACAAAGGTAGGTCACC | 59 | 11576 | 11595 | 318 |
| 544215 | n/a | n/a | ATATGACATGTATATTGGAT | 41 | 11620 | 11639 | 319 |
| 544216 | n/a | n/a | TTTTGTACTTTTCTGGAACA | 34 | 11704 | 11723 | 320 |
| 544217 | n/a | n/a | TAGTCTGTGGTCCTGAAAAT | 32 | 11748 | 11767 | 321 |
| 544218 | n/a | n/a | AGCTTAGTCTGTGGTCCTGA | 20 | 11752 | 11771 | 322 |
| 544219 | n/a | n/a | GACAGCTTAGTCTGTGGTCC | 45 | 11755 | 11774 | 323 |
| 544220 | n/a | n/a | GTATTCTGGCCCTAAAAAAA | 2 | 11789 | 11808 | 324 |
| 544221 | n/a | n/a | ATTTTGGTATTCTGGCCCTA | 39 | 11795 | 11814 | 325 |
| 544223 | n/a | n/a | TTTGCATTTGAAATTGTCCA | 32 | 11837 | 11856 | 326 |
| 544224 | n/a | n/a | GGAAGCAACTCATATATTAA | 39 | 11869 | 11888 | 327 |
| 544225 | n/a | n/a | TATCAGAAAAAGATACCTGA | 0 | 9821 | 9840 | 328 |
| 544226 | n/a | n/a | ATAATAGCTAATAATGTGGG | 15 | 9875 | 9894 | 329 |
| 544227 | n/a | n/a | TGCAGATAATAGCTAATAAT | 31 | 9880 | 9899 | 330 |
| 544228 | n/a | n/a | TGTCATTGCAGATAATAGCT | 61 | 9886 | 9905 | 331 |
| 544229 | n/a | n/a | TAAAAGTTGTCATTGCAGAT | 38 | 9893 | 9912 | 332 |
| 544230 | n/a | n/a | CGGATTTTTAAAAGTTGTCA | 45 | 9901 | 9920 | 333 |
| 544231 | n/a | n/a | GGGATTCGGATTTTTAAAAG | 0 | 9907 | 9926 | 334 |
| 544232 | n/a | n/a | TTTGGGATTCGGATTTTTAA | 24 | 9910 | 9929 | 335 |
| 544233 | n/a | n/a | ACGCTTATTTGGGATTCGGA | 53 | 9917 | 9936 | 336 |
| 544251 | n/a | n/a | TTTAAGAGATTTACAAGTCA | 11 | 2811 | 2830 | 337 |
| 544252 | n/a | n/a | GACTACCTGTTTTTAAAAGC | 6 | 2851 | 2870 | 338 |
| 544253 | n/a | n/a | TATGGTGACTACCTGTTTTT | 12 | 2857 | 2876 | 339 |
| 544254 | n/a | n/a | ACTTTGCTGTATTATAAACT | 12 | 2890 | 2909 | 340 |
| 544255 | n/a | n/a | ATTGTATTTAACTTTGCTGT | 0 | 2900 | 2919 | 341 |
| 544256 | n/a | n/a | GAGCAACTAACTTAATAGGT | 13 | 2928 | 2947 | 342 |
| 544257 | n/a | n/a | GAAATGAGCAACTAACTTAA | 25 | 2933 | 2952 | 343 |
| 544258 | n/a | n/a | AATCAAAGAAATGAGCAACT | 0 | 2940 | 2959 | 344 |
| 544259 | n/a | n/a | ACCTTCTTCCACATTGAGTT | 8 | 2977 | 2996 | 345 |
| 544260 | n/a | n/a | CACGAATGTAACCTTCTTCC | 0 | 2987 | 3006 | 346 |
| 544261 | n/a | n/a | TTAACTTGCACGAATGTAAC | 27 | 2995 | 3014 | 347 |
| 544262 | n/a | n/a | TATATATACCAATATTTGCC | 0 | 3063 | 3082 | 348 |
| 544263 | n/a | n/a | TCTTAACTCTATATATACCA | 0 | 3072 | 3091 | 349 |
| 544264 | n/a | n/a | CTTTAAGTGAAGTTACTTCT | 17 | 3632 | 3651 | 350 |
| 544265 | n/a | n/a | TCTACTTACTTTAAGTGAAG | 9 | 3640 | 3659 | 351 |
| 544266 | n/a | n/a | GAACCCTCTTTATTTTCTAC | 1 | 3655 | 3674 | 352 |
| 544267 | n/a | n/a | ACATAAACATGAACCCTCTT | 6 | 3665 | 3684 | 353 |
| 544268 | n/a | n/a | CCACATTGAAAACATAAACA | 25 | 3676 | 3695 | 354 |
| 544269 | n/a | n/a | GCATGCCTTAGAAATATTTT | 7 | 3707 | 3726 | 355 |
| 544270 | n/a | n/a | CAATGCAACAAAGTATTTCA | 0 | 3731 | 3750 | 356 |
| 544271 | n/a | n/a | CTGGAGATTATTTTCTTGG | 34 | 3768 | 3787 | 357 |
| 544272 | n/a | n/a | TTCATATATAACATTAGGGA | 0 | 3830 | 3849 | 358 |
| 544273 | n/a | n/a | TCAGTGTTTTCATATATAAC | 18 | 3838 | 3857 | 359 |
| 544274 | n/a | n/a | GACATAGTGTTCTAGATTGT | 14 | 3900 | 3919 | 360 |
| 544275 | n/a | n/a | CAATAGTGTAATGACATAGT | 21 | 3912 | 3931 | 361 |
| 544276 | n/a | n/a | TTACTTACCTTCAGTAATTT | 0 | 3933 | 3952 | 362 |
| 544277 | n/a | n/a | ATCTTTTCCATTTACTGTAT | 8 | 4005 | 4024 | 363 |
| 544278 | n/a | n/a | AGAAAAAGCCCAGCATATTT | 11 | 4037 | 4056 | 364 |
| 544279 | n/a | n/a | GTATGCTTCTTTCAAATAGC | 36 | 4130 | 4149 | 365 |
| 544280 | n/a | n/a | CCTTCCCCTTGTATGCTTCT | 41 | 4140 | 4159 | 366 |
| 544281 | n/a | n/a | CCTGTAACACTATCATAATC | 1 | 4207 | 4226 | 367 |
| 544282 | n/a | n/a | TGACTTACCTGATTTTCTAT | 6 | 4384 | 4403 | 368 |
| 544283 | n/a | n/a | GATGGGACATACCATTAAAA | 0 | 4407 | 4426 | 369 |
| 544284 | n/a | n/a | GTGAAAGATGGGACATACCA | 20 | 4413 | 4432 | 370 |
| 544285 | n/a | n/a | CCTGTGTGAAAGATGGGACA | 6 | 4418 | 4437 | 371 |
| 544286 | n/a | n/a | CATTGGCTGCTATGAATTAA | 41 | 4681 | 4700 | 372 |
| 544287 | n/a | n/a | GATGACATTGGCTGCTATGA | 40 | 4686 | 4705 | 373 |
| 544288 | n/a | n/a | GAGAAACATGATCTAATTTG | 12 | 4717 | 4736 | 374 |
| 544289 | n/a | n/a | ATGGAAAGCTATTGTGTGGT | 0 | 4747 | 4766 | 375 |
| 544290 | n/a | n/a | GTCTAAAGAGCCAATATGAG | 22 | 4771 | 4790 | 376 |
| 544291 | n/a | n/a | AATCTTGGTCTAAAGAGCCA | 46 | 4778 | 4797 | 377 |
| 544433 | n/a | n/a | GAGATTTACAAGTCAAAAAT | 4 | 2806 | 2825 | 378 |
| 544434 | n/a | n/a | ATTTAACTTTGCTGTATTAT | 0 | 2895 | 2914 | 379 |
| 544435 | n/a | n/a | ATCAATGCTAAATGAAATCA | 0 | 2955 | 2974 | 380 |

TABLE 126-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544436 | n/a | n/a | TATTTTCTGGAGATTATTTT | 0 | 3774 | 3793 | 381 |
| 544437 | n/a | n/a | AAAATGAATATTGGCAATTC | 0 | 4159 | 4178 | 382 |
| 233717 | 889 | 908 | TGAATTAATGTCCATGGACT | 36 | 7876 | 7895 | 14 |
| 544202 | 2081 | 2100 | AAAGTCAATGTGACTTAGTA | 42 | 11053 | 11072 | 383 |
| 544203 | 2104 | 2123 | AAGGTATAGTGATACCTCAT | 56 | 11076 | 11095 | 384 |

TABLE 127

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544127 | 765 | 784 | CAGCAGGAATGCCATCATGT | 4 | N/A | N/A | 385 |
| 544128 | 819 | 838 | TGATGGCATACATGCCACTT | 0 | 7404 | 7423 | 386 |
| 544129 | 828 | 847 | TGCTGGGTCTGATGGCATAC | 44 | 7413 | 7432 | 387 |
| 544130 | 832 | 851 | GAGTTGCTGGGTCTGATGGC | 16 | 7417 | 7436 | 388 |
| 544131 | 841 | 860 | AAAACTTGAGAGTTGCTGGG | 0 | 7426 | 7445 | 389 |
| 544132 | 848 | 867 | GACATGAAAAACTTGAGAGT | 0 | 7433 | 7452 | 390 |
| 544133 | 859 | 878 | ACATCACAGTAGACATGAAA | 25 | 7444 | 7463 | 391 |
| 233717 | 889 | 908 | TGAATTAATGTCCATGGACT | 36 | 7876 | 7895 | 14 |
| 544134 | 915 | 934 | AGTTTTGTGATCCATCTATT | 46 | 7902 | 7921 | 392 |
| 544135 | 918 | 937 | TGAAGTTTTGTGATCCATCT | 42 | 7905 | 7924 | 393 |
| 544136 | 926 | 945 | CGTTTCATTGAAGTTTTGTG | 45 | 7913 | 7932 | 394 |
| 544137 | 946 | 965 | CCATATTTGTAGTTCTCCCA | 44 | 7933 | 7952 | 395 |
| 544138 | 949 | 968 | AAACCATATTTGTAGTTCTC | 25 | 7936 | 7955 | 396 |
| 544139 | 970 | 989 | AATTCTCCATCAAGCCTCCC | 35 | N/A | N/A | 397 |
| 233722 | 991 | 1010 | ATCTTCTCTAGGCCCAACCA | 65 | 9566 | 9585 | 398 |
| 544432 | 997 | 1016 | GAGTATATCTTCTCTAGGCC | 0 | 9572 | 9591 | 399 |
| 544140 | 1002 | 1021 | CTATGGAGTATATCTTCTCT | 6 | 9577 | 9596 | 400 |
| 544141 | 1008 | 1027 | GCTTCACTATGGAGTATATC | 63 | 9583 | 9602 | 401 |
| 544142 | 1013 | 1032 | AGATTGCTTCACTATGGAGT | 52 | 9588 | 9607 | 402 |
| 544143 | 1046 | 1065 | CCAGTCTTCCAACTCAATTC | 35 | 9621 | 9640 | 403 |
| 544144 | 1052 | 1071 | GTCTTTCCAGTCTTCCAACT | 64 | 9627 | 9646 | 404 |
| 544145 | 1055 | 1074 | GTTGTCTTTCCAGTCTTCCA | 80 | 9630 | 9649 | 16 |
| 544146 | 1059 | 1078 | GTTTGTTGTCTTTCCAGTCT | 59 | 9634 | 9653 | 405 |
| 544147 | 1062 | 1081 | AATGTTTGTTGTCTTTCCAG | 12 | 9637 | 9656 | 406 |
| 544148 | 1095 | 1114 | CGTGATTTCCCAAGTAAAAA | 56 | 9670 | 9689 | 407 |
| 544149 | 1160 | 1179 | GTTTTCCGGGATTGCATTGG | 33 | 9735 | 9754 | 408 |
| 544150 | 1165 | 1184 | TCTTTGTTTTCCGGGATTGC | 54 | 9740 | 9759 | 409 |
| 544151 | 1170 | 1189 | CCAAATCTTTGTTTTCCGGG | 64 | 9745 | 9764 | 410 |
| 544152 | 1173 | 1192 | ACACCAAATCTTTGTTTTCC | 37 | 9748 | 9767 | 411 |
| 544153 | 1178 | 1197 | AGAAAACACCAAATCTTTGT | 32 | 9753 | 9772 | 412 |
| 544154 | 1183 | 1202 | CAAGTAGAAAACACCAAATC | 13 | 9758 | 9777 | 413 |
| 544155 | 1188 | 1207 | GATCCCAAGTAGAAAACACC | 0 | 9763 | 9782 | 414 |
| 544156 | 1195 | 1214 | GCTTGTGATCCCAAGTAGA | 74 | 9770 | 9789 | 17 |
| 544157 | 1198 | 1217 | TTTGCTTTGTGATCCCAAGT | 73 | 9773 | 9792 | 415 |
| 544158 | 1202 | 1221 | TCCTTTTGCTTTGTGATCCC | 62 | 9777 | 9796 | 416 |
| 544159 | 1208 | 1227 | GAAGTGTCCTTTTGCTTTGT | 30 | 9783 | 9802 | 417 |
| 544160 | 1246 | 1265 | TGCCACCACCAGCCTCCTGA | 60 | N/A | N/A | 418 |
| 544161 | 1253 | 1272 | CTCATCATGCCACCACCAGC | 73 | 10225 | 10244 | 419 |
| 544162 | 1269 | 1288 | GGTTGTTTTCTCCACACTCA | 76 | 10241 | 10260 | 18 |
| 544163 | 1276 | 1295 | CCATTTAGGTTGTTTTCTCC | 25 | 10248 | 10267 | 420 |
| 544164 | 1283 | 1302 | ATATTTACCATTTAGGTTGT | 25 | 10255 | 10274 | 421 |
| 544165 | 1294 | 1313 | CTTGGTTTGTTATATTTACC | 63 | 10266 | 10285 | 422 |
| 544166 | 1353 | 1372 | ACCTTCCATTTTGAGACTTC | 75 | 10325 | 10344 | 19 |
| 544167 | 1363 | 1382 | ATAGAGTATAACCTTCCATT | 71 | 10335 | 10354 | 423 |
| 544168 | 1367 | 1386 | TTTTATAGAGTATAACCTTC | 37 | 10339 | 10358 | 424 |
| 544169 | 1374 | 1393 | TGGTTGATTTTATAGAGTAT | 37 | 10346 | 10365 | 425 |
| 544170 | 1378 | 1397 | ATTTTGGTTGATTTATAGA | 3 | 10350 | 10369 | 426 |
| 544171 | 1383 | 1402 | TCAACATTTTGGTTGATTTT | 16 | 10355 | 10374 | 427 |
| 544172 | 1390 | 1409 | GGATGGATCAACATTTTGGT | 51 | 10362 | 10381 | 428 |
| 544173 | 1393 | 1412 | GTTGGATGGATCAACATTTT | 62 | 10365 | 10384 | 429 |
| 544174 | 1396 | 1415 | TCTGTTGGATGGATCAACAT | 5 | 10368 | 10387 | 430 |
| 544175 | 1401 | 1420 | CTGAATCTGTTGGATGGATC | 55 | 10373 | 10392 | 431 |
| 544176 | 1407 | 1426 | AGCTTTCTGAATCTGTTGGA | 65 | 10379 | 10398 | 432 |

TABLE 127-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544177 | 1414 | 1433 | CATTCAAAGCTTTCTGAATC | 21 | 10386 | 10405 | 433 |
| 544178 | 1417 | 1436 | GTTCATTCAAAGCTTTCTGA | 66 | 10389 | 10408 | 434 |
| 544179 | 1420 | 1439 | TCAGTTCATTCAAAGCTTTC | 6 | 10392 | 10411 | 435 |
| 544180 | 1423 | 1442 | GCCTCAGTTCATTCAAAGCT | 68 | 10395 | 10414 | 436 |
| 544181 | 1427 | 1446 | ATTTGCCTCAGTTCATTCAA | 53 | 10399 | 10418 | 437 |
| 544182 | 1431 | 1450 | TTAAATTTGCCTCAGTTCAT | 40 | 10403 | 10422 | 438 |
| 544183 | 1436 | 1455 | GCCTTTTAAATTTGCCTCAG | 70 | 10408 | 10427 | 439 |
| 544184 | 1498 | 1517 | AGGATTTAATACCAGATTAT | 38 | 10470 | 10489 | 440 |
| 544185 | 1502 | 1521 | CTTAAGGATTTAATACCAGA | 56 | 10474 | 10493 | 441 |
| 544186 | 1505 | 1524 | TCTCTTAAGGATTTAATACC | 33 | 10477 | 10496 | 442 |
| 544187 | 1546 | 1565 | GACAGTGACTTTAAGATAAA | 35 | 10518 | 10537 | 443 |
| 544188 | 1572 | 1591 | TGTGATTGTATGTTTAATCT | 48 | 10544 | 10563 | 444 |
| 544189 | 1578 | 1597 | AGGTTATGTGATTGTATGTT | 48 | 10550 | 10569 | 445 |
| 544190 | 1583 | 1602 | CTTTAAGGTTATGTGATTGT | 48 | 10555 | 10574 | 446 |
| 544191 | 1589 | 1608 | GGTATTCTTTAAGGTTATGT | 62 | 10561 | 10580 | 447 |
| 544192 | 1656 | 1675 | ATTGATTCCCACATCACAAA | 47 | 10628 | 10647 | 448 |
| 544193 | 1661 | 1680 | CTAAAATTGATTCCCACATC | 67 | 10633 | 10652 | 449 |
| 544194 | 1665 | 1684 | CCATCTAAAATTGATTCCCA | 63 | 10637 | 10656 | 450 |
| 544195 | 1771 | 1790 | TTGTGATATTAGCTCATATG | 59 | 10743 | 10762 | 451 |
| 544196 | 1794 | 1813 | ACTAGTTTTTTAAACTGGGA | 28 | 10766 | 10785 | 452 |
| 544197 | 1820 | 1839 | GTCAAGTTTAGAGTTTTAAC | 44 | 10792 | 10811 | 453 |
| 544198 | 1826 | 1845 | TATTTAGTCAAGTTTAGAGT | 14 | 10798 | 10817 | 454 |
| 544199 | 1907 | 1926 | TACACATACTCTGTGCTGAC | 82 | 10879 | 10898 | 20 |
| 544200 | 1913 | 1932 | GATTTTTACACATACTCTGT | 57 | 10885 | 10904 | 455 |
| 544201 | 2008 | 2027 | CTGCTTCATTAGGTTTCATA | 61 | 10980 | 10999 | 456 |

TABLE 128

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544127 | 765 | 784 | CAGCAGGAATGCCATCATGT | 0 | N/A | N/A | 457 |
| 544128 | 819 | 838 | TGATGGCATACATGCCACTT | 13 | 7404 | 7423 | 458 |
| 544129 | 828 | 847 | TGCTGGGTCTGATGGCATAC | 49 | 7413 | 7432 | 459 |
| 544130 | 832 | 851 | GAGTTGCTGGGTCTGATGGC | 27 | 7417 | 7436 | 460 |
| 544131 | 841 | 860 | AAAACTTGAGAGTTGCTGGG | 0 | 7426 | 7445 | 461 |
| 544132 | 848 | 867 | GACATGAAAAACTTGAGAGT | 0 | 7433 | 7452 | 462 |
| 544133 | 859 | 878 | ACATCACAGTAGACATGAAA | 18 | 7444 | 7463 | 463 |
| 233717 | 889 | 908 | TGAATTAATGTCCATGGACT | 55 | 7876 | 7895 | 14 |
| 544134 | 915 | 934 | AGTTTTGTGATCCATCTATT | 68 | 7902 | 7921 | 464 |
| 544135 | 918 | 937 | TGAAGTTTTGTGATCCATCT | 77 | 7905 | 7924 | 465 |
| 544136 | 926 | 945 | CGTTTCATTGAAGTTTTGTG | 60 | 7913 | 7932 | 466 |
| 544137 | 946 | 965 | CCATATTTGTAGTTCTCCCA | 64 | 7933 | 7952 | 467 |
| 544138 | 949 | 968 | AAACCATATTTGTAGTTCTC | 45 | 7936 | 7955 | 468 |
| 544139 | 970 | 989 | AATTCTCCATCAAGCCTCCC | 70 | N/A | N/A | 469 |
| 233722 | 991 | 1010 | ATCTTCTCTAGGCCCAACCA | 96 | 9566 | 9585 | 470 |
| 544432 | 997 | 1016 | GAGTATATCTTCTCTAGGCC | 69 | 9572 | 9591 | 471 |
| 544140 | 1002 | 1021 | CTATGGAGTATATCTTCTCT | 37 | 9577 | 9596 | 472 |
| 544141 | 1008 | 1027 | GCTTCACTATGGAGTATATC | 65 | 9583 | 9602 | 473 |
| 544142 | 1013 | 1032 | AGATTGCTTCACTATGGAGT | 55 | 9588 | 9607 | 474 |
| 544143 | 1046 | 1065 | CCAGTCTTCCAACTCAATTC | 31 | 9621 | 9640 | 475 |
| 544144 | 1052 | 1071 | GTCTTTCCAGTCTTCCAACT | 72 | 9627 | 9646 | 476 |
| 544145 | 1055 | 1074 | GTTGTCTTTCCAGTCTTCCA | 86 | 9630 | 9649 | 16 |
| 544146 | 1059 | 1078 | GTTTGTTGTCTTTCCAGTCT | 66 | 9634 | 9653 | 477 |
| 544147 | 1062 | 1081 | AATGTTTGTTGTCTTTCCAG | 21 | 9637 | 9656 | 478 |
| 544148 | 1095 | 1114 | CGTGATTTCCCAAGTAAAAA | 63 | 9670 | 9689 | 479 |
| 544149 | 1160 | 1179 | GTTTTCCGGGATTGCATTGG | 32 | 9735 | 9754 | 480 |
| 544150 | 1165 | 1184 | TCTTTGTTTTCCGGGATTGC | 48 | 9740 | 9759 | 481 |
| 544151 | 1170 | 1189 | CCAAATCTTTGTTTTCCGGG | 72 | 9745 | 9764 | 482 |
| 544152 | 1173 | 1192 | ACACCAAATCTTTGTTTTCC | 39 | 9748 | 9767 | 483 |
| 544153 | 1178 | 1197 | AGAAAACACCAAATCTTTGT | 39 | 9753 | 9772 | 484 |
| 544154 | 1183 | 1202 | CAAGTAGAAAACACCAAATC | 22 | 9758 | 9777 | 485 |
| 544155 | 1188 | 1207 | GATCCCAAGTAGAAAACACC | 5 | 9763 | 9782 | 486 |
| 544156 | 1195 | 1214 | GCTTTGTGATCCCAAGTAGA | 79 | 9770 | 9789 | 17 |

TABLE 128-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544157 | 1198 | 1217 | TTTGCTTTGTGATCCCAAGT | 80 | 9773 | 9792 | 487 |
| 544158 | 1202 | 1221 | TCCTTTTGCTTTGTGATCCC | 73 | 9777 | 9796 | 488 |
| 544159 | 1208 | 1227 | GAAGTGTCCTTTTGCTTTGT | 33 | 9783 | 9802 | 489 |
| 544160 | 1246 | 1265 | TGCCACCACCAGCCTCCTGA | 67 | N/A | N/A | 490 |
| 544161 | 1253 | 1272 | CTCATCATGCCACCACCAGC | 79 | 10225 | 10244 | 491 |
| 544162 | 1269 | 1288 | GGTTGTTTTCTCCACACTCA | 84 | 10241 | 10260 | 18 |
| 544163 | 1276 | 1295 | CCATTTAGGTTGTTTTCTCC | 34 | 10248 | 10267 | 492 |
| 544164 | 1283 | 1302 | ATATTTACCATTTAGGTTGT | 17 | 10255 | 10274 | 493 |
| 544165 | 1294 | 1313 | CTTGGTTTGTTATATTTACC | 76 | 10266 | 10285 | 494 |
| 544166 | 1353 | 1372 | ACCTTCCATTTTGAGACTTC | 79 | 10325 | 10344 | 19 |
| 544167 | 1363 | 1382 | ATAGAGTATAACCTTCCATT | 73 | 10335 | 10354 | 495 |
| 544168 | 1367 | 1386 | TTTTATAGAGTATAACCTTC | 41 | 10339 | 10358 | 496 |
| 544169 | 1374 | 1393 | TGGTTGATTTTATAGAGTAT | 53 | 10346 | 10365 | 497 |
| 544170 | 1378 | 1397 | ATTTTGGTTGATTTTATAGA | 28 | 10350 | 10369 | 498 |
| 544171 | 1383 | 1402 | TCAACATTTTGGTTGATTTT | 19 | 10355 | 10374 | 499 |
| 544172 | 1390 | 1409 | GGATGGATCAACATTTTGGT | 66 | 10362 | 10381 | 500 |
| 544173 | 1393 | 1412 | GTTGGATGGATCAACATTTT | 71 | 10365 | 10384 | 501 |
| 544174 | 1396 | 1415 | TCTGTTGGATGGATCAACAT | 35 | 10368 | 10387 | 502 |
| 544175 | 1401 | 1420 | CTGAATCTGTTGGATGGATC | 68 | 10373 | 10392 | 503 |
| 544176 | 1407 | 1426 | AGCTTTCTGAATCTGTTGGA | 70 | 10379 | 10398 | 504 |
| 544177 | 1414 | 1433 | CATTCAAAGCTTTCTGAATC | 35 | 10386 | 10405 | 505 |
| 544178 | 1417 | 1436 | GTTCATTCAAAGCTTTCTGA | 76 | 10389 | 10408 | 506 |
| 544179 | 1420 | 1439 | TCAGTTCATTCAAAGCTTTC | 15 | 10392 | 10411 | 507 |
| 544180 | 1423 | 1442 | GCCTCAGTTCATTCAAAGCT | 68 | 10395 | 10414 | 508 |
| 544181 | 1427 | 1446 | ATTTGCCTCAGTTCATTCAA | 67 | 10399 | 10418 | 509 |
| 544182 | 1431 | 1450 | TTAAATTTGCCTCAGTTCAT | 51 | 10403 | 10422 | 510 |
| 544183 | 1436 | 1455 | GCCTTTTAAATTTGCCTCAG | 80 | 10408 | 10427 | 511 |
| 544184 | 1498 | 1517 | AGGATTTAATACCAGATTAT | 54 | 10470 | 10489 | 512 |
| 544185 | 1502 | 1521 | CTTAAGGATTTAATACCAGA | 69 | 10474 | 10493 | 513 |
| 544186 | 1505 | 1524 | TCTCTTAAGGATTTAATACC | 58 | 10477 | 10496 | 514 |
| 544187 | 1546 | 1565 | GACAGTGACTTTAAGATAAA | 34 | 10518 | 10537 | 515 |
| 544188 | 1572 | 1591 | TGTGATTGTATGTTTAATCT | 47 | 10544 | 10563 | 516 |
| 544189 | 1578 | 1597 | AGGTTATGTGATTGTATGTT | 68 | 10550 | 10569 | 517 |
| 544190 | 1583 | 1602 | CTTTAAGGTTATGTGATTGT | 62 | 10555 | 10574 | 518 |
| 544191 | 1589 | 1608 | GGTATTCTTTAAGGTTATGT | 66 | 10561 | 10580 | 519 |
| 544192 | 1656 | 1675 | ATTGATTCCCACATCACAAA | 50 | 10628 | 10647 | 520 |
| 544193 | 1661 | 1680 | CTAAAATTGATTCCCACATC | 73 | 10633 | 10652 | 521 |
| 544194 | 1665 | 1684 | CCATCTAAAATTGATTCCCA | 73 | 10637 | 10656 | 522 |
| 544195 | 1771 | 1790 | TTGTGATATTAGCTCATATG | 57 | 10743 | 10762 | 523 |
| 544196 | 1794 | 1813 | ACTAGTTTTTTAAACTGGGA | 21 | 10766 | 10785 | 524 |
| 544197 | 1820 | 1839 | GTCAAGTTTAGAGTTTTAAC | 53 | 10792 | 10811 | 525 |
| 544198 | 1826 | 1845 | TATTTAGTCAAGTTTAGAGT | 11 | 10798 | 10817 | 526 |
| 544199 | 1907 | 1926 | TACACATACTCTGTGCTGAC | 84 | 10879 | 10898 | 20 |
| 544200 | 1913 | 1932 | GATTTTTACACATACTCTGT | 53 | 10885 | 10904 | 527 |
| 544201 | 2008 | 2027 | CTGCTTCATTAGGTTTCATA | 67 | 10980 | 10999 | 528 |

TABLE 129

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544127 | 765 | 784 | CAGCAGGAATGCCATCATGT | 18 | N/A | N/A | 529 |
| 544128 | 819 | 838 | TGATGGCATACATGCCACTT | 0 | 7404 | 7423 | 530 |
| 544129 | 828 | 847 | TGCTGGGTCTGATGGCATAC | 48 | 7413 | 7432 | 531 |
| 544130 | 832 | 851 | GAGTTGCTGGGTCTGATGGC | 14 | 7417 | 7436 | 532 |
| 544131 | 841 | 860 | AAAACTTGAGAGTTGCTGGG | 5 | 7426 | 7445 | 533 |
| 544132 | 848 | 867 | GACATGAAAAACTTGAGAGT | 0 | 7433 | 7452 | 534 |
| 544133 | 859 | 878 | ACATCACAGTAGACATGAAA | 28 | 7444 | 7463 | 535 |
| 233717 | 889 | 908 | TGAATTAATGTCCATGGACT | 51 | 7876 | 7895 | 14 |
| 544134 | 915 | 934 | AGTTTTGTGATCCATCTATT | 36 | 7902 | 7921 | 536 |
| 544135 | 918 | 937 | TGAAGTTTTGTGATCCATCT | 61 | 7905 | 7924 | 537 |
| 544136 | 926 | 945 | CGTTTCATTGAAGTTTTGTG | 54 | 7913 | 7932 | 538 |
| 544137 | 946 | 965 | CCATATTTGTAGTTCTCCCA | 67 | 7933 | 7952 | 539 |
| 544138 | 949 | 968 | AAACCATATTTGTAGTTCTC | 39 | 7936 | 7955 | 540 |

TABLE 129-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544139 | 970 | 989 | AATTCTCCATCAAGCCTCCC | 77 | N/A | N/A | 541 |
| 233722 | 991 | 1010 | ATCTTCTCTAGGCCCAACCA | 95 | 9566 | 9585 | 542 |
| 544432 | 997 | 1016 | GAGTATATCTTCTCTAGGCC | 86 | 9572 | 9591 | 543 |
| 544140 | 1002 | 1021 | CTATGGAGTATATCTTCTCT | 57 | 9577 | 9596 | 544 |
| 544141 | 1008 | 1027 | GCTTCACTATGGAGTATATC | 52 | 9583 | 9602 | 545 |
| 544142 | 1013 | 1032 | AGATTGCTTCACTATGGAGT | 40 | 9588 | 9607 | 546 |
| 544143 | 1046 | 1065 | CCAGTCTTCCAACTCAATTC | 32 | 9621 | 9640 | 547 |
| 544144 | 1052 | 1071 | GTCTTTCCAGTCTTCCAACT | 53 | 9627 | 9646 | 548 |
| 544145 | 1055 | 1074 | GTTGTCTTTCCAGTCTTCCA | 80 | 9630 | 9649 | 16 |
| 544146 | 1059 | 1078 | GTTTGTTGTCTTTCCAGTCT | 59 | 9634 | 9653 | 549 |
| 544147 | 1062 | 1081 | AATGTTTGTTGTCTTTCCAG | 42 | 9637 | 9656 | 550 |
| 544148 | 1095 | 1114 | CGTGATTTCCCAAGTAAAAA | 76 | 9670 | 9689 | 551 |
| 544149 | 1160 | 1179 | GTTTTCCGGGATTGCATTGG | 29 | 9735 | 9754 | 552 |
| 544150 | 1165 | 1184 | TCTTTGTTTTCCGGGATTGC | 50 | 9740 | 9759 | 553 |
| 544151 | 1170 | 1189 | CCAAATCTTTGTTTTCCGGG | 56 | 9745 | 9764 | 554 |
| 544152 | 1173 | 1192 | ACACCAAATCTTTGTTTTCC | 26 | 9748 | 9767 | 555 |
| 544153 | 1178 | 1197 | AGAAAACACCAAATCTTTGT | 22 | 9753 | 9772 | 556 |
| 544154 | 1183 | 1202 | CAAGTAGAAAACACCAAATC | 29 | 9758 | 9777 | 557 |
| 544155 | 1188 | 1207 | GATCCCAAGTAGAAAACACC | 16 | 9763 | 9782 | 558 |
| 544156 | 1195 | 1214 | GCTTTGTGATCCCAAGTAGA | 71 | 9770 | 9789 | 17 |
| 544157 | 1198 | 1217 | TTTGCTTTGTGATCCCAAGT | 55 | 9773 | 9792 | 559 |
| 544158 | 1202 | 1221 | TCCTTTTGCTTTGTGATCCC | 51 | 9777 | 9796 | 560 |
| 544159 | 1208 | 1227 | GAAGTGTCCTTTTGCTTTGT | 8 | 9783 | 9802 | 561 |
| 544160 | 1246 | 1265 | TGCCACCACCAGCCTCCTGA | 68 | N/A | N/A | 562 |
| 544161 | 1253 | 1272 | CTCATCATGCCACCACCAGC | 48 | 10225 | 10244 | 563 |
| 544162 | 1269 | 1288 | GGTTGTTTTCTCCACACTCA | 74 | 10241 | 10260 | 18 |
| 544163 | 1276 | 1295 | CCATTTAGGTTGTTTTCTCC | 33 | 10248 | 10267 | 564 |
| 544164 | 1283 | 1302 | ATATTTACCATTTAGGTTGT | 0 | 10255 | 10274 | 565 |
| 544165 | 1294 | 1313 | CTTGGTTTGTTATATTTACC | 52 | 10266 | 10285 | 566 |
| 544166 | 1353 | 1372 | ACCTTCCATTTGAGACTTC | 69 | 10325 | 10344 | 19 |
| 544167 | 1363 | 1382 | ATAGAGTATAACCTTCCATT | 72 | 10335 | 10354 | 567 |
| 544168 | 1367 | 1386 | TTTTATAGAGTATAACCTTC | 27 | 10339 | 10358 | 568 |
| 544169 | 1374 | 1393 | TGGTTGATTTTATAGAGTAT | 39 | 10346 | 10365 | 569 |
| 544170 | 1378 | 1397 | ATTTTGGTTGATTTTATAGA | 7 | 10350 | 10369 | 570 |
| 544171 | 1383 | 1402 | TCAACATTTTGGTTGATTTT | 0 | 10355 | 10374 | 571 |
| 544172 | 1390 | 1409 | GGATGGATCAACATTTTGGT | 48 | 10362 | 10381 | 572 |
| 544173 | 1393 | 1412 | GTTGGATGGATCAACATTTT | 51 | 10365 | 10384 | 573 |
| 544174 | 1396 | 1415 | TCTGTTGGATGGATCAACAT | 46 | 10368 | 10387 | 574 |
| 544175 | 1401 | 1420 | CTGAATCTGTTGGATGGATC | 58 | 10373 | 10392 | 575 |
| 544176 | 1407 | 1426 | AGCTTTCTGAATCTGTTGGA | 57 | 10379 | 10398 | 576 |
| 544177 | 1414 | 1433 | CATTCAAAGCTTTCTGAATC | 0 | 10386 | 10405 | 577 |
| 544178 | 1417 | 1436 | GTTCATTCAAAGCTTTCTGA | 62 | 10389 | 10408 | 578 |
| 544179 | 1420 | 1439 | TCAGTTCATTCAAAGCTTTC | 21 | 10392 | 10411 | 579 |
| 544180 | 1423 | 1442 | GCCTCAGTTCATTCAAAGCT | 73 | 10395 | 10414 | 580 |
| 544181 | 1427 | 1446 | ATTTGCCTCAGTTCATTCAA | 46 | 10399 | 10418 | 581 |
| 544182 | 1431 | 1450 | TTAAATTTGCCTCAGTTCAT | 52 | 10403 | 10422 | 582 |
| 544183 | 1436 | 1455 | GCCTTTTAAATTTGCCTCAG | 66 | 10408 | 10427 | 583 |
| 544184 | 1498 | 1517 | AGGATTTAATACCAGATTAT | 31 | 10470 | 10489 | 584 |
| 544185 | 1502 | 1521 | CTTAAGGATTTAATACCAGA | 49 | 10474 | 10493 | 585 |
| 544186 | 1505 | 1524 | TCTCTTAAGGATTTAATACC | 49 | 10477 | 10496 | 586 |
| 544187 | 1546 | 1565 | GACAGTGACTTTAAGATAAA | 27 | 10518 | 10537 | 587 |
| 544188 | 1572 | 1591 | TGTGATTGTATGTTTAATCT | 30 | 10544 | 10563 | 588 |
| 544189 | 1578 | 1597 | AGGTTATGTGATTGTATGTT | 35 | 10550 | 10569 | 589 |
| 544190 | 1583 | 1602 | CTTTAAGGTTATGTGATTGT | 50 | 10555 | 10574 | 590 |
| 544191 | 1589 | 1608 | GGTATTCTTTAAGGTTATGT | 54 | 10561 | 10580 | 591 |
| 544192 | 1656 | 1675 | ATTGATTCCCACATCACAAA | 47 | 10628 | 10647 | 592 |
| 544193 | 1661 | 1680 | CTAAAATTGATTCCCACATC | 69 | 10633 | 10652 | 593 |
| 544194 | 1665 | 1684 | CCATCTAAAATTGATTCCCA | 74 | 10637 | 10656 | 594 |
| 544195 | 1771 | 1790 | TTGTGATATTAGCTCATATG | 54 | 10743 | 10762 | 595 |
| 544196 | 1794 | 1813 | ACTAGTTTTTAAACTGGGA | 27 | 10766 | 10785 | 596 |
| 544197 | 1820 | 1839 | GTCAAGTTTAGAGTTTTAAC | 18 | 10792 | 10811 | 597 |
| 544198 | 1826 | 1845 | TATTTAGTCAAGTTTAGAGT | 12 | 10798 | 10817 | 598 |
| 544199 | 1907 | 1926 | TACACATACTCTGTGCTGAC | 83 | 10879 | 10898 | 20 |
| 544200 | 1913 | 1932 | GATTTTTACACATACTCTGT | 58 | 10885 | 10904 | 599 |
| 544201 | 2008 | 2027 | CTGCTTCATTAGGTTTCATA | 62 | 10980 | 10999 | 600 |

TABLE 130

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337520 | N/A | N/A | CAGTGTTATTCAGATTGTAC | 64 | 6517 | 6536 | 601 |
| 337521 | N/A | N/A | AGTGTCTTACCATCATGTTT | 40 | 6776 | 6795 | 602 |
| 337525 | N/A | N/A | CACCAGCCTCCTAAAGGAGA | 39 | 10212 | 10231 | 603 |
| 544292 | N/A | N/A | GAGGAGGTGAAGTCAGTGAG | 35 | 4815 | 4834 | 604 |
| 544293 | N/A | N/A | TAGAGTAGAGGAGGTGAAGT | 23 | 4822 | 4841 | 605 |
| 544294 | N/A | N/A | TGTTTGATGTGTTTGAATAC | 19 | 4863 | 4882 | 606 |
| 544295 | N/A | N/A | GAAACAACAAGGGCAAAGGC | 23 | 4898 | 4917 | 607 |
| 544296 | N/A | N/A | TGTTTGATAACGACCCTAAG | 43 | 4974 | 4993 | 608 |
| 544297 | N/A | N/A | TTTTTGGTTAAGTGACCTTG | 48 | 5016 | 5035 | 609 |
| 544298 | N/A | N/A | GTAGAAGTTTTCAGGGATGG | 23 | 5052 | 5071 | 610 |
| 544299 | N/A | N/A | AGGAAGTAGAAGTTTTCAGG | 5 | 5057 | 5076 | 611 |
| 544300 | N/A | N/A | AGGTGAGTGTGCAGGAGAAA | 11 | 5085 | 5104 | 612 |
| 544301 | N/A | N/A | TTAAATAAAGGTGAGTGTGC | 14 | 5093 | 5112 | 613 |
| 544302 | N/A | N/A | AGTGCAGGAATAGAAGAGAT | 35 | 5136 | 5155 | 614 |
| 544303 | N/A | N/A | CATTTTAGTGCAGGAATAGA | 21 | 5142 | 5161 | 615 |
| 544306 | N/A | N/A | CTATATTCTGGAGTATATAC | 39 | 5216 | 5235 | 616 |
| 544307 | N/A | N/A | CAGTATTCTATATTCTGGAG | 72 | 5223 | 5242 | 617 |
| 544308 | N/A | N/A | GTGCCATACAGTATTCTATA | 50 | 5231 | 5250 | 618 |
| 544309 | N/A | N/A | CTGTGTGAATATGACATTAC | 52 | 5281 | 5300 | 619 |
| 544310 | N/A | N/A | TGAGGCACACTATTTCTAGT | 47 | 5333 | 5352 | 620 |
| 544311 | N/A | N/A | GACCTTTAATTATGAGGCAC | 67 | 5345 | 5364 | 621 |
| 544312 | N/A | N/A | GAATGTTGACCTTTAATTAT | 23 | 5352 | 5371 | 622 |
| 544313 | N/A | N/A | TTGTTGAATGTTGACCTTTA | 69 | 5357 | 5376 | 623 |
| 544314 | N/A | N/A | TCTACTAAGTAACTATGTGA | 37 | 5915 | 5934 | 624 |
| 544315 | N/A | N/A | CTCTTTTCTACTAAGTAACT | 31 | 5921 | 5940 | 625 |
| 544316 | N/A | N/A | AAGGATCTATTGTAAAGTTT | 24 | 5956 | 5975 | 626 |
| 544317 | N/A | N/A | CTAGGACCTTATTTAAAAGG | 24 | 5972 | 5991 | 627 |
| 544318 | N/A | N/A | ATTTCCTAGGACCTTATTTA | 8 | 5977 | 5996 | 628 |
| 544319 | N/A | N/A | TTGACAGTAAGAAAAGCAGA | 28 | 6051 | 6070 | 629 |
| 544320 | N/A | N/A | TTCTCATTGACAGTAAGAAA | 56 | 6057 | 6076 | 630 |
| 544321 | N/A | N/A | AGTTTTTCTCATTGACAGTA | 50 | 6062 | 6081 | 631 |
| 544322 | N/A | N/A | ATTGAATGATAGTTTTTCTC | 42 | 6072 | 6091 | 632 |
| 544323 | N/A | N/A | TTGGGTTTGCAATTTATTGA | 36 | 6087 | 6106 | 633 |
| 544324 | N/A | N/A | AGTGTGTTGGGTTTGCAATT | 25 | 6093 | 6112 | 634 |
| 544325 | N/A | N/A | TATTTAAGTGTGTTGGGTTT | 27 | 6099 | 6118 | 635 |
| 544326 | N/A | N/A | ATATATTCAGTAGTTTATCG | 25 | 6145 | 6164 | 636 |
| 544327 | N/A | N/A | AGATGTTGGCAGGTTGGCAA | 51 | 6184 | 6203 | 637 |
| 544328 | N/A | N/A | TCTGTAGATGTTGGCAGGTT | 48 | 6189 | 6208 | 638 |
| 544329 | N/A | N/A | TTGATAATTTTTGACCTGTA | 34 | 6215 | 6234 | 639 |
| 544330 | N/A | N/A | GGCTTTCTTGATAATTTGAT | 52 | 6230 | 6249 | 640 |
| 544331 | N/A | N/A | GTCTTACTGATCTTCAGACC | 27 | 6282 | 6301 | 641 |
| 544332 | N/A | N/A | TTTAGGTCTTACTGATCTTC | 14 | 6287 | 6306 | 642 |
| 544333 | N/A | N/A | TCAGTTTTAGGTCTTACTGA | 28 | 6292 | 6311 | 643 |
| 544334 | N/A | N/A | TGATATTCTGTTCAGATTTT | 44 | 6326 | 6345 | 644 |
| 544335 | N/A | N/A | TAGAGACTGCTTTGCTTAGA | 31 | 6388 | 6407 | 645 |
| 544336 | N/A | N/A | AGGCCAAAAGTAGAGACTGC | 29 | 6398 | 6417 | 646 |
| 544337 | N/A | N/A | GGCAAAAAAGCAGACATTGG | 38 | 6433 | 6452 | 647 |
| 544338 | N/A | N/A | AATCAGGGACATTATTTAAT | 13 | 6473 | 6492 | 648 |
| 544339 | N/A | N/A | TATTTAATCAGGGACATTAT | 28 | 6478 | 6497 | 649 |
| 544340 | N/A | N/A | CTCAAAATATTTAATCAGGG | 27 | 6485 | 6504 | 650 |
| 544341 | N/A | N/A | TACCTGTTCTCAAAATATTT | 18 | 6493 | 6512 | 651 |
| 544342 | N/A | N/A | GTACAGATTACCTGTTCTCA | 68 | 6501 | 6520 | 652 |
| 544343 | N/A | N/A | GGTGTTTGATATTTAGATAA | 25 | 6538 | 6557 | 653 |
| 544344 | N/A | N/A | TTGTCTTTCAGTTCATAATG | 29 | 6565 | 6584 | 654 |
| 544345 | N/A | N/A | ACAGTTTGTCTTTCAGTTCA | 23 | 6570 | 6589 | 655 |
| 544346 | N/A | N/A | TCTGAGCTGATAAAAGAATA | 15 | 6657 | 6676 | 656 |
| 544347 | N/A | N/A | CCCACCAAAGTGTCTTACCA | 49 | 6784 | 6803 | 657 |
| 544348 | N/A | N/A | CTTCAAGAAGGAAACCCACC | 39 | 6798 | 6817 | 658 |
| 544349 | N/A | N/A | AATAGCTTCAAGAAGGAAAC | 12 | 6803 | 6822 | 659 |
| 544350 | N/A | N/A | ACAAGTCCTAAGAATAGGGA | 25 | 6833 | 6852 | 660 |
| 544351 | N/A | N/A | GTCTAGAACAAGTCCTAAGA | 53 | 6840 | 6859 | 661 |
| 544352 | N/A | N/A | TCTAATAATCAAGTCCATAT | 33 | 6972 | 6991 | 662 |
| 544353 | N/A | N/A | ACCTTCTATATTATCTAATA | 19 | 6985 | 7004 | 663 |
| 544354 | N/A | N/A | GCATGTATCTCTTAAACAGG | 50 | 7060 | 7079 | 664 |
| 544355 | N/A | N/A | TTTCAGCATGTATCTCTTAA | 79 | 7065 | 7084 | 21 |
| 544356 | N/A | N/A | GTCCAGTGACCTTTAACTCC | 69 | 7092 | 7111 | 665 |
| 544357 | N/A | N/A | TCTTACCAAACTATTTTCTT | 28 | 7166 | 7185 | 666 |
| 544358 | N/A | N/A | GTAATGTTTATGTTAAAGCA | 17 | 7226 | 7245 | 667 |
| 544359 | N/A | N/A | TTGTGGCAAATGTAGCATTT | 52 | 7251 | 7270 | 668 |
| 544360 | N/A | N/A | GAGATTTCACTTGACATTTT | 30 | 7277 | 7296 | 669 |
| 544361 | N/A | N/A | GGAGCTTGAGATTTCACTTG | 30 | 7284 | 7303 | 670 |
| 544362 | N/A | N/A | CATCAGATTTAGTAATAGGA | 0 | 7315 | 7334 | 671 |
| 544363 | N/A | N/A | GTTATTACATCAGATTTAGT | 6 | 7322 | 7341 | 672 |

TABLE 130-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544365 | N/A | N/A | CAGCAGGAATGCCTAGAATC | 32 | 7350 | 7369 | 673 |
| 544366 | N/A | N/A | CTCCTTAGACAGGTTTTACC | 31 | 7471 | 7490 | 674 |
| 544367 | N/A | N/A | GTCTATTCTCCTTAGACAGG | 23 | 7478 | 7497 | 675 |
| 544368 | N/A | N/A | ACCAGGTTAATCTTCCTAAT | 71 | 7526 | 7545 | 22 |
| 544369 | N/A | N/A | ATGAATGATTGAATGTAGTC | 26 | 7977 | 7996 | 676 |
| 544370 | N/A | N/A | ATATGAAGGCTGAGACTGCT | 58 | 8072 | 8091 | 677 |
| 544371 | N/A | N/A | ATAAATTATATGAAGGCTGA | 7 | 8079 | 8098 | 678 |
| 544372 | N/A | N/A | ATATTTAAGAACAGACATGT | 12 | 8175 | 8194 | 679 |
| 544373 | N/A | N/A | AGTTATGATCATTGTAAGCC | 60 | 8217 | 8236 | 23 |
| 544374 | N/A | N/A | ATTTGTAACAGTTACTACTT | 51 | 8276 | 8295 | 680 |
| 544375 | N/A | N/A | CACAGCTTATTTGTAACAGT | 70 | 8284 | 8303 | 681 |
| 544376 | N/A | N/A | GGAGTGGTTCTTTTCACAGC | 71 | 8298 | 8317 | 24 |
| 544377 | N/A | N/A | GTGACTAATGCTAGGAGTGG | 34 | 8311 | 8330 | 682 |
| 544378 | N/A | N/A | GAATAGAGTGACTAATGCTA | 45 | 8318 | 8337 | 683 |
| 544379 | N/A | N/A | ATGAGAGAATAGAGTGACTA | 58 | 8324 | 8343 | 684 |
| 544380 | N/A | N/A | TGGTCCTTTTAACTTCCAAT | 70 | 8365 | 8384 | 25 |
| 544381 | N/A | N/A | TATACTGTATGTCTGAGTTT | 66 | 8387 | 8406 | 685 |
| 544382 | N/A | N/A | AACTAATTCATTATAAGCCA | 67 | 8450 | 8469 | 686 |
| 544383 | N/A | N/A | GCATTGAGTTAACTAATTCA | 64 | 8460 | 8479 | 26 |
| 544385 | N/A | N/A | TTTGGATTTTAAACATCTGT | 61 | 8528 | 8547 | 687 |
| 544386 | N/A | N/A | TGTATGTGCTTTTTGGATTT | 37 | 8539 | 8558 | 688 |
| 544387 | N/A | N/A | CATGGATTTTTGTATGTGCT | 62 | 8549 | 8568 | 689 |
| 544388 | N/A | N/A | TCATTCATGGATTTTTGTAT | 34 | 8554 | 8573 | 690 |
| 544389 | N/A | N/A | ACTTAGACATCATTCATGGA | 55 | 8563 | 8582 | 691 |
| 544390 | N/A | N/A | GTGAGTACTTAGACATCATT | 66 | 8569 | 8588 | 692 |
| 544391 | N/A | N/A | TTTATAAGTGAGTACTTAGA | 36 | 8576 | 8595 | 693 |
| 544392 | N/A | N/A | GTCTTCTACTTTATAAGTGA | 65 | 8585 | 8604 | 694 |
| 544393 | N/A | N/A | ATGAATGTCTTCTACTTTAT | 34 | 8591 | 8610 | 695 |
| 544394 | N/A | N/A | CAAATAGTACTGAGCATTTA | 30 | 8627 | 8646 | 696 |
| 544395 | N/A | N/A | TTAGAAGATTTGGAGCTACA | 54 | 8718 | 8737 | 697 |
| 544396 | N/A | N/A | TCACTATTAGAAGATTTGGA | 37 | 8724 | 8743 | 698 |
| 544397 | N/A | N/A | GGGTTACACTCACTATTAGA | 36 | 8733 | 8752 | 699 |
| 544398 | N/A | N/A | ACTTACCTGTCAGCCTTTTA | 54 | 8758 | 8777 | 700 |
| 544399 | N/A | N/A | CTTACCAGAATTAAGTGAGT | 26 | 8785 | 8804 | 701 |
| 544400 | N/A | N/A | AATACAAGTACAAATGGGTT | 22 | 8810 | 8829 | 702 |
| 544401 | N/A | N/A | CTGGTAAATACAAGTACAAA | 55 | 8816 | 8835 | 703 |
| 544402 | N/A | N/A | GGATTGCTGGTAAATACAAG | 40 | 8822 | 8841 | 704 |
| 544403 | N/A | N/A | TCATTTTAAGGATTGCTGGT | 62 | 8831 | 8850 | 705 |
| 544404 | N/A | N/A | AGTTAGTAGGAAGCTTCATT | 56 | 8846 | 8865 | 706 |
| 544405 | N/A | N/A | GCTATTGAGTTAGTAGGAAG | 67 | 8853 | 8872 | 707 |
| 544407 | N/A | N/A | AGCATGGTTCTTAATAACTT | 67 | 9012 | 9031 | 708 |
| 544408 | N/A | N/A | CTTTGTAGAAAAAGACAGGA | 27 | 9062 | 9081 | 709 |
| 544409 | N/A | N/A | ACCTGGCCTTTGGTATTTGC | 49 | 9096 | 9115 | 710 |
| 544410 | N/A | N/A | CATCCATATACAGTCAAGAG | 80 | 9174 | 9193 | 27 |
| 544411 | N/A | N/A | AGTCTTTATATGGATAAACT | 15 | 9215 | 9234 | 711 |
| 544412 | N/A | N/A | CGTCATTGGTAGAGGAATAT | 51 | 9240 | 9259 | 712 |
| 544413 | N/A | N/A | GATTATCCTTTCTATAATGC | 48 | 9321 | 9340 | 713 |
| 544414 | N/A | N/A | GTCTTGAATCCCTTGATCAT | 40 | 9436 | 9455 | 714 |
| 544415 | N/A | N/A | GGTGCAACTAATTGAGTTGT | 27 | 9459 | 9478 | 715 |
| 544416 | N/A | N/A | GTGTTTTTATTGGTGCAAC | 31 | 9471 | 9490 | 716 |
| 544417 | N/A | N/A | ATTCTCCTGAAAAGAAAAGT | 24 | 9544 | 9563 | 717 |
| 544418 | N/A | N/A | ATGCCACCACCAGCCTCCTA | 73 | 10219 | 10238 | 718 |
| 544419 | N/A | N/A | ATATCCTTTAACAAATGGGT | 62 | 11540 | 11559 | 719 |
| 544420 | N/A | N/A | GCACTATATCCTTTAACAAA | 50 | 11545 | 11564 | 720 |
| 544421 | N/A | N/A | ACTTGGGCACTATATCCTTT | 68 | 11551 | 11570 | 721 |
| 544422 | N/A | N/A | GAAACATGTCCTATGAGAGT | 32 | 11918 | 11937 | 722 |
| 544424 | N/A | N/A | TTGAGCACTTTAAGCAAAGT | 7 | 12070 | 12089 | 723 |
| 544425 | N/A | N/A | GGAATTTGAGCACTTTAAGC | 34 | 12075 | 12094 | 724 |
| 544426 | N/A | N/A | TAGATTAGACAACTGTGAGT | 52 | 12101 | 12120 | 725 |
| 544427 | N/A | N/A | AAAATGAAGGTCAAGTTTGA | 17 | 12197 | 12216 | 726 |
| 544428 | N/A | N/A | GTGAAAGCAAAATGAAGGTC | 33 | 12205 | 12224 | 727 |
| 544429 | N/A | N/A | GTATTGTGAAAGCAAAATGA | 39 | 12210 | 12229 | 728 |
| 544430 | N/A | N/A | TGGAGAGTATAGTATTGTGA | 35 | 12221 | 12240 | 729 |
| 544438 | N/A | N/A | AGGAATAGAAGAGATAAATA | 10 | 5131 | 5150 | 730 |
| 544439 | N/A | N/A | TGGAGTATATACAAATAATG | 30 | 5208 | 5227 | 731 |
| 544440 | N/A | N/A | TGTTTACATTGTAGATTAAT | 15 | 5381 | 5400 | 732 |
| 544441 | N/A | N/A | CAGAATATATAATATCTTGC | 57 | 6035 | 6054 | 733 |
| 544442 | N/A | N/A | TGCAATTTATTGAATGATAG | 31 | 6080 | 6099 | 734 |
| 544443 | N/A | N/A | CATAATACATAATTTGAACC | 0 | 6251 | 6270 | 735 |
| 544444 | N/A | N/A | ATAATTTTCAGTTTTAGGTC | 0 | 6299 | 6318 | 736 |
| 544445 | N/A | N/A | TTTCAGTAATGTTTATGTTA | 9 | 7231 | 7250 | 737 |
| 544446 | N/A | N/A | AATGCCTAGAATCAATAAAA | 36 | 7343 | 7362 | 738 |
| 544447 | N/A | N/A | GTAAATATTTGTAGATTAGC | 49 | 8003 | 8022 | 739 |

TABLE 130-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544448 | N/A | N/A | ACAAATGTGTAATTGTTTGA | 25 | 8101 | 8120 | 740 |
| 544449 | N/A | N/A | TACTAACAAATGTGTAATTG | 35 | 8106 | 8125 | 741 |
| 544450 | N/A | N/A | TGATAAGTATATTTAAGAAC | 35 | 8183 | 8202 | 742 |
| 544451 | N/A | N/A | TTAACTTCCAATTAATTGAT | 29 | 8357 | 8376 | 743 |
| 544452 | N/A | N/A | TCTGTTATTTTATCTTGCTT | 67 | 8513 | 8532 | 744 |
| 544453 | N/A | N/A | ATCACAATCCTTTTTATTAA | 18 | 8921 | 8940 | 745 |
| 544454 | N/A | N/A | AGAGACTTGAGTAATAATAA | 25 | 9137 | 9156 | 746 |
| 544455 | N/A | N/A | AACAAAATGAAACATGTCCT | 59 | 11926 | 11945 | 747 |
| 544127 | 765 | 784 | CAGCAGGAATGCCATCATGT | 33 | N/A | N/A | 748 |
| 544128 | 819 | 838 | TGATGGCATACATGCCACTT | 13 | 7404 | 7423 | 749 |
| 544129 | 828 | 847 | TGCTGGGTCTGATGGCATAC | 53 | 7413 | 7432 | 750 |
| 544130 | 832 | 851 | GAGTTGCTGGGTCTGATGGC | 22 | 7417 | 7436 | 751 |
| 544131 | 841 | 860 | AAAACTTGAGAGTTGCTGGG | 13 | 7426 | 7445 | 752 |
| 544132 | 848 | 867 | GACATGAAAAACTTGAGAGT | 0 | 7433 | 7452 | 753 |
| 544133 | 859 | 878 | ACATCACAGTAGACATGAAA | 27 | 7444 | 7463 | 754 |
| 233717 | 889 | 908 | TGAATTAATGTCCATGGACT | 58 | 7876 | 7895 | 14 |
| 544134 | 915 | 934 | AGTTTTGTGATCCATCTATT | 46 | 7902 | 7921 | 755 |
| 544135 | 918 | 937 | TGAAGTTTTGTGATCCATCT | 54 | 7905 | 7924 | 756 |
| 544136 | 926 | 945 | CGTTTCATTGAAGTTTTGTG | 40 | 7913 | 7932 | 757 |
| 544137 | 946 | 965 | CCATATTTGTAGTTCTCCCA | 45 | 7933 | 7952 | 758 |
| 544138 | 949 | 968 | AAACCATATTTGTAGTTCTC | 41 | 7936 | 7955 | 759 |
| 544139 | 970 | 989 | AATTCTCCATCAAGCCTCCC | 43 | N/A | N/A | 760 |
| 233722 | 991 | 1010 | ATCTTCTCTAGGCCCAACCA | 65 | 9566 | 9585 | 761 |
| 544432 | 997 | 1016 | GAGTATATCTTCTCTAGGCC | 40 | 9572 | 9591 | 762 |
| 544140 | 1002 | 1021 | CTATGGAGTATATCTTCTCT | 28 | 9577 | 9596 | 763 |
| 544141 | 1008 | 1027 | GCTTCACTATGGAGTATATC | 55 | 9583 | 9602 | 764 |
| 544142 | 1013 | 1032 | AGATTGCTTCACTATGGAGT | 47 | 9588 | 9607 | 765 |
| 544143 | 1046 | 1065 | CCAGTCTTCCAACTCAATTC | 33 | 9621 | 9640 | 766 |
| 544144 | 1052 | 1071 | GTCTTTCCAGTCTTCCAACT | 59 | 9627 | 9646 | 767 |
| 544145 | 1055 | 1074 | GTTGTCTTTCCAGTCTTCCA | 77 | 9630 | 9649 | 16 |
| 544146 | 1059 | 1078 | GTTTGTTGTCTTTCCAGTCT | 58 | 9634 | 9653 | 768 |
| 544147 | 1062 | 1081 | AATGTTTGTTGTCTTTCCAG | 43 | 9637 | 9656 | 769 |
| 544148 | 1095 | 1114 | CGTGATTTCCCAAGTAAAAA | 57 | 9670 | 9689 | 770 |
| 544149 | 1160 | 1179 | GTTTTCCGGGATTGCATTGG | 44 | 9735 | 9754 | 771 |
| 544150 | 1165 | 1184 | TCTTTGTTTTCCGGGATTGC | 53 | 9740 | 9759 | 772 |
| 544151 | 1170 | 1189 | CCAAATCTTTGTTTTCCGGG | 57 | 9745 | 9764 | 773 |
| 544152 | 1173 | 1192 | ACACCAAATCTTTGTTTTCC | 44 | 9748 | 9767 | 774 |
| 544153 | 1178 | 1197 | AGAAAACACCAAATCTTTGT | 36 | 9753 | 9772 | 775 |
| 544154 | 1183 | 1202 | CAAGTAGAAAACACCAAATC | 29 | 9758 | 9777 | 776 |
| 544155 | 1188 | 1207 | GATCCCAAGTAGAAAACACC | 29 | 9763 | 9782 | 777 |
| 544156 | 1195 | 1214 | GCTTTGTGATCCCAAGTAGA | 71 | 9770 | 9789 | 17 |
| 544157 | 1198 | 1217 | TTTGCTTTGTGATCCCAAGT | 66 | 9773 | 9792 | 778 |
| 544158 | 1202 | 1221 | TCCTTTTGCTTTGTGATCCC | 53 | 9777 | 9796 | 779 |
| 544159 | 1208 | 1227 | GAAGTGTCCTTTTGCTTTGT | 10 | 9783 | 9802 | 780 |
| 544160 | 1246 | 1265 | TGCCACCACCAGCCTCCTGA | 65 | N/A | N/A | 781 |
| 544161 | 1253 | 1272 | CTCATCATGCCACCACCAGC | 59 | 10225 | 10244 | 782 |
| 544162 | 1269 | 1288 | GGTTGTTTTCTCCACACTCA | 74 | 10241 | 10260 | 18 |
| 544163 | 1276 | 1295 | CCATTTAGGTTGTTTTCTCC | 38 | 10248 | 10267 | 783 |
| 544164 | 1283 | 1302 | ATATTTACCATTTAGGTTGT | 13 | 10255 | 10274 | 784 |
| 544165 | 1294 | 1313 | CTTGGTTTGTTATATTTACC | 53 | 10266 | 10285 | 785 |
| 544166 | 1353 | 1372 | ACCTTCCATTTTGAGACTTC | 70 | 10325 | 10344 | 19 |
| 544167 | 1363 | 1382 | ATAGAGTATAACCTTCCATT | 69 | 10335 | 10354 | 786 |
| 544168 | 1367 | 1386 | TTTTATAGAGTATAACCTTC | 34 | 10339 | 10358 | 787 |
| 544169 | 1374 | 1393 | TGGTTGATTTTATAGAGTAT | 38 | 10346 | 10365 | 788 |
| 544170 | 1378 | 1397 | ATTTTGGTTGATTTTATAGA | 0 | 10350 | 10369 | 789 |
| 544171 | 1383 | 1402 | TCAACATTTTGGTTGATTTT | 12 | 10355 | 10374 | 790 |
| 544172 | 1390 | 1409 | GGATGGATCAACATTTTGGT | 58 | 10362 | 10381 | 791 |
| 544173 | 1393 | 1412 | GTTGGATGGATCAACATTTT | 66 | 10365 | 10384 | 792 |
| 544174 | 1396 | 1415 | TCTGTTGGATGGATCAACAT | 49 | 10368 | 10387 | 793 |
| 544175 | 1401 | 1420 | CTGAATCTGTTGGATGGATC | 60 | 10373 | 10392 | 794 |
| 544176 | 1407 | 1426 | AGCTTTCTGAATCTGTTGGA | 64 | 10379 | 10398 | 795 |
| 544177 | 1414 | 1433 | CATTCAAAGCTTTCTGAATC | 21 | 10386 | 10405 | 796 |
| 544178 | 1417 | 1436 | GTTCATTCAAAGCTTTCTGA | 60 | 10389 | 10408 | 797 |
| 544179 | 1420 | 1439 | TCAGTTCATTCAAAGCTTTC | 18 | 10392 | 10411 | 798 |
| 544180 | 1423 | 1442 | GCCTCAGTTCATTCAAAGCT | 72 | 10395 | 10414 | 799 |
| 544181 | 1427 | 1446 | ATTTGCCTCAGTTCATTCAA | 51 | 10399 | 10418 | 800 |
| 544182 | 1431 | 1450 | TTAAATTTGCCTCAGTTCAT | 48 | 10403 | 10422 | 801 |
| 544183 | 1436 | 1455 | GCCTTTTAAATTTGCCTCAG | 70 | 10408 | 10427 | 802 |
| 544184 | 1498 | 1517 | AGGATTTAATACCAGATTAT | 44 | 10470 | 10489 | 803 |
| 544185 | 1502 | 1521 | CTTAAGGATTTAATACCAGA | 47 | 10474 | 10493 | 804 |
| 544186 | 1505 | 1524 | TCTCTTAAGGATTTAATACC | 44 | 10477 | 10496 | 805 |
| 544187 | 1546 | 1565 | GACAGTGACTTTAAGATAAA | 38 | 10518 | 10537 | 806 |
| 544188 | 1572 | 1591 | TGTGATTGTATGTTTAATCT | 47 | 10544 | 10563 | 807 |

TABLE 130-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544189 | 1578 | 1597 | AGGTTATGTGATTGTATGTT | 43 | 10550 | 10569 | 808 |
| 544190 | 1583 | 1602 | CTTTAAGGTTATGTGATTGT | 42 | 10555 | 10574 | 809 |
| 544191 | 1589 | 1608 | GGTATTCTTTAAGGTTATGT | 60 | 10561 | 10580 | 810 |
| 544192 | 1656 | 1675 | ATTGATTCCCACATCACAAA | 46 | 10628 | 10647 | 811 |
| 544193 | 1661 | 1680 | CTAAAATTGATTCCCACATC | 65 | 10633 | 10652 | 812 |
| 544194 | 1665 | 1684 | CCATCTAAAATTGATTCCCA | 70 | 10637 | 10656 | 813 |
| 544195 | 1771 | 1790 | TTGTGATATTAGCTCATATG | 56 | 10743 | 10762 | 814 |
| 544196 | 1794 | 1813 | ACTAGTTTTTTAAACTGGGA | 33 | 10766 | 10785 | 815 |
| 544197 | 1820 | 1839 | GTCAAGTTTAGAGTTTTAAC | 39 | 10792 | 10811 | 816 |
| 544198 | 1826 | 1845 | TATTTAGTCAAGTTTAGAGT | 21 | 10798 | 10817 | 817 |
| 544199 | 1907 | 1926 | TACACATACTCTGTGCTGAC | 80 | 10879 | 10898 | 20 |
| 544200 | 1913 | 1932 | GATTTTTACACATACTCTGT | 56 | 10885 | 10904 | 818 |
| 544201 | 2008 | 2027 | CTGCTTCATTAGGTTTCATA | 65 | 10980 | 10999 | 819 |

TABLE 131

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337525 | N/A | N/A | CACCAGCCTCCTAAAGGAGA | 58 | 10212 | 10231 | 820 |
| 544204 | N/A | N/A | GACTTCTTAACTCTATATAT | 67 | 3076 | 3095 | 821 |
| 544205 | N/A | N/A | CTAGACTTCTTAACTCTATA | 61 | 3079 | 3098 | 822 |
| 544206 | N/A | N/A | GACCTAGACTTCTTAACTCT | 54 | 3082 | 3101 | 823 |
| 544207 | N/A | N/A | GGAAGCAGACCTAGACTTCT | 58 | 3089 | 3108 | 824 |
| 544208 | N/A | N/A | TCTGGAAGCAGACCTAGACT | 48 | 3092 | 3111 | 825 |
| 544209 | N/A | N/A | TCTTCTGGAAGCAGACCTAG | 54 | 3095 | 3114 | 826 |
| 544210 | N/A | N/A | CTAATCTTTAGGGATTTAGG | 57 | 11433 | 11452 | 827 |
| 544211 | N/A | N/A | TGTATCTAATCTTTAGGGAT | 53 | 11438 | 11457 | 828 |
| 544213 | N/A | N/A | TAACTTGGGCACTATATCCT | 74 | 11553 | 11572 | 829 |
| 544214 | N/A | N/A | ATTGACAAAGGTAGGTCACC | 79 | 11576 | 11595 | 830 |
| 544215 | N/A | N/A | ATATGACATGTATATTGGAT | 66 | 11620 | 11639 | 831 |
| 544216 | N/A | N/A | TTTTGTACTTTTCTGGAACA | 61 | 11704 | 11723 | 832 |
| 544217 | N/A | N/A | TAGTCTGTGGTCCTGAAAAT | 56 | 11748 | 11767 | 833 |
| 544218 | N/A | N/A | AGCTTAGTCTGTGGTCCTGA | 72 | 11752 | 11771 | 834 |
| 544219 | N/A | N/A | GACAGCTTAGTCTGTGGTCC | 74 | 11755 | 11774 | 835 |
| 544220 | N/A | N/A | GTATTCTGGCCCTAAAAAAA | 52 | 11789 | 11808 | 836 |
| 544221 | N/A | N/A | ATTTTGGTATTCTGGCCCTA | 56 | 11795 | 11814 | 837 |
| 544222 | N/A | N/A | GAAATTGTCCAATTTTTGGG | 56 | N/A | N/A | 838 |
| 544223 | N/A | N/A | TTTGCATTTGAAATTGTCCA | 61 | 11837 | 11856 | 839 |
| 544224 | N/A | N/A | GGAAGCAACTCATATATTAA | 57 | 11869 | 11888 | 840 |
| 544225 | N/A | N/A | TATCAGAAAAAGATACCTGA | 56 | 9821 | 9840 | 841 |
| 544226 | N/A | N/A | ATAATAGCTAATAATGTGGG | 59 | 9875 | 9894 | 842 |
| 544227 | N/A | N/A | TGCAGATAATAGCTAATAAT | 60 | 9880 | 9899 | 843 |
| 544228 | N/A | N/A | TGTCATTGCAGATAATAGCT | 79 | 9886 | 9905 | 844 |
| 544229 | N/A | N/A | TAAAAGTTGTCATTGCAGAT | 59 | 9893 | 9912 | 845 |
| 544230 | N/A | N/A | CGGATTTTAAAAGTTGTCA | 61 | 9901 | 9920 | 846 |
| 544231 | N/A | N/A | GGGATTCGGATTTTTAAAAG | 28 | 9907 | 9926 | 847 |
| 544232 | N/A | N/A | TTTGGGATTCGGATTTTTAA | 44 | 9910 | 9929 | 848 |
| 544233 | N/A | N/A | ACGCTTATTTGGGATTCGGA | 72 | 9917 | 9936 | 849 |
| 544251 | N/A | N/A | TTTAAGAGATTTACAAGTCA | 52 | 2811 | 2830 | 850 |
| 544252 | N/A | N/A | GACTACCTGTTTTTAAAAGC | 48 | 2851 | 2870 | 851 |
| 544253 | N/A | N/A | TATGGTGACTACCTGTTTTT | 39 | 2857 | 2876 | 852 |
| 544254 | N/A | N/A | ACTTTGCTGTATTATAAACT | 35 | 2890 | 2909 | 853 |
| 544255 | N/A | N/A | ATTGTATTTAACTTTGCTGT | 35 | 2900 | 2919 | 854 |
| 544256 | N/A | N/A | GAGCAACTAACTTAATAGGT | 42 | 2928 | 2947 | 855 |
| 544257 | N/A | N/A | GAAATGAGCAACTAACTTAA | 32 | 2933 | 2952 | 856 |
| 544258 | N/A | N/A | AATCAAAGAAATGAGCAACT | 42 | 2940 | 2959 | 857 |
| 544259 | N/A | N/A | ACCTTCTTCCACATTGAGTT | 44 | 2977 | 2996 | 858 |
| 544260 | N/A | N/A | CACGAATGTAACCTTCTTCC | 52 | 2987 | 3006 | 859 |
| 544261 | N/A | N/A | TTAACTTGCACGAATGTAAC | 45 | 2995 | 3014 | 860 |
| 544262 | N/A | N/A | TATATATACCAATATTTGCC | 43 | 3063 | 3082 | 861 |
| 544263 | N/A | N/A | TCTTAACTCTATATATACCA | 49 | 3072 | 3091 | 862 |
| 544264 | N/A | N/A | CTTTAAGTGAAGTTACTTCT | 53 | 3632 | 3651 | 863 |
| 544265 | N/A | N/A | TCTACTTACTTTAAGTGAAG | 44 | 3640 | 3659 | 864 |
| 544266 | N/A | N/A | GAACCCTCTTTATTTTCTAC | 46 | 3655 | 3674 | 865 |
| 544267 | N/A | N/A | ACATAAACATGAACCCTCTT | 50 | 3665 | 3684 | 866 |

TABLE 131-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544268 | N/A | N/A | CCACATTGAAAACATAAACA | 57 | 3676 | 3695 | 867 |
| 544269 | N/A | N/A | GCATGCCTTAGAAATATTTT | 23 | 3707 | 3726 | 868 |
| 544270 | N/A | N/A | CAATGCAACAAAGTATTTCA | 37 | 3731 | 3750 | 869 |
| 544271 | N/A | N/A | CTGGAGATTATTTTTCTTGG | 61 | 3768 | 3787 | 870 |
| 544272 | N/A | N/A | TTCATATATAACATTAGGGA | 14 | 3830 | 3849 | 871 |
| 544273 | N/A | N/A | TCAGTGTTTTCATATATAAC | 32 | 3838 | 3857 | 872 |
| 544274 | N/A | N/A | GACATAGTGTTCTAGATTGT | 47 | 3900 | 3919 | 873 |
| 544275 | N/A | N/A | CAATAGTGTAATGACATAGT | 39 | 3912 | 3931 | 874 |
| 544276 | N/A | N/A | TTACTTACCTTCAGTAATTT | 35 | 3933 | 3952 | 875 |
| 544277 | N/A | N/A | ATCTTTTCCATTTACTGTAT | 39 | 4005 | 4024 | 876 |
| 544278 | N/A | N/A | AGAAAAAGCCCAGCATATTT | 23 | 4037 | 4056 | 877 |
| 544279 | N/A | N/A | GTATGCTTCTTTCAAATAGC | 46 | 4130 | 4149 | 878 |
| 544280 | N/A | N/A | CCTTCCCCTTGTATGCTTCT | 47 | 4140 | 4159 | 879 |
| 544281 | N/A | N/A | CCTGTAACACTATCATAATC | 49 | 4207 | 4226 | 880 |
| 544282 | N/A | N/A | TGACTTACCTGATTTTCTAT | 24 | 4384 | 4403 | 881 |
| 544283 | N/A | N/A | GATGGGACATACCATTAAAA | 41 | 4407 | 4426 | 882 |
| 544284 | N/A | N/A | GTGAAAGATGGGACATACCA | 54 | 4413 | 4432 | 883 |
| 544285 | N/A | N/A | CCTGTGTGAAAGATGGGACA | 27 | 4418 | 4437 | 884 |
| 544286 | N/A | N/A | CATTGGCTGCTATGAATTAA | 45 | 4681 | 4700 | 885 |
| 544287 | N/A | N/A | GATGACATTGGCTGCTATGA | 49 | 4686 | 4705 | 886 |
| 544288 | N/A | N/A | GAGAAACATGATCTAATTTG | 33 | 4717 | 4736 | 887 |
| 544289 | N/A | N/A | ATGGAAAGCTATTGTGTGGT | 42 | 4747 | 4766 | 888 |
| 544290 | N/A | N/A | GTCTAAAGAGCCAATATGAG | 39 | 4771 | 4790 | 889 |
| 544291 | N/A | N/A | AATCTTGGTCTAAAGAGCCA | 65 | 4778 | 4797 | 890 |
| 544361 | N/A | N/A | GGAGCTTGAGATTTCACTTG | 66 | 7284 | 7303 | 891 |
| 544362 | N/A | N/A | CATCAGATTTAGTAATAGGA | 61 | 7315 | 7334 | 892 |
| 544363 | N/A | N/A | GTTATTACATCAGATTTAGT | 63 | 7322 | 7341 | 893 |
| 544365 | N/A | N/A | CAGCAGGAATGCCTAGAATC | 72 | 7350 | 7369 | 894 |
| 544366 | N/A | N/A | CTCCTTAGACAGGTTTTACC | 67 | 7471 | 7490 | 895 |
| 544367 | N/A | N/A | GTCTATTCTCCTTAGACAGG | 59 | 7478 | 7497 | 896 |
| 544368 | N/A | N/A | ACCAGGTTAATCTTCCTAAT | 79 | 7526 | 7545 | 22 |
| 544369 | N/A | N/A | ATGAATGATTGAATGTAGTC | 56 | 7977 | 7996 | 897 |
| 544370 | N/A | N/A | ATATGAAGGCTGAGACTGCT | 73 | 8072 | 8091 | 898 |
| 544371 | N/A | N/A | ATAAATTATATGAAGGCTGA | 51 | 8079 | 8098 | 899 |
| 544372 | N/A | N/A | ATATTTAAGAACAGACATGT | 54 | 8175 | 8194 | 900 |
| 544373 | N/A | N/A | AGTTATGATCATTGTAAGCC | 77 | 8217 | 8236 | 23 |
| 544374 | N/A | N/A | ATTTGTAACAGTTACTACTT | 69 | 8276 | 8295 | 901 |
| 544375 | N/A | N/A | CACAGCTTATTTGTAACAGT | 72 | 8284 | 8303 | 902 |
| 544376 | N/A | N/A | GGAGTGGTTCTTTTCACAGC | 82 | 8298 | 8317 | 24 |
| 544377 | N/A | N/A | GTGACTAATGCTAGGAGTGG | 54 | 8311 | 8330 | 903 |
| 544378 | N/A | N/A | GAATAGAGTGACTAATGCTA | 55 | 8318 | 8337 | 904 |
| 544379 | N/A | N/A | ATGAGAGAATAGAGTGACTA | 66 | 8324 | 8343 | 905 |
| 544380 | N/A | N/A | TGGTCCTTTTAACTTCCAAT | 79 | 8365 | 8384 | 25 |
| 544381 | N/A | N/A | TATACTGTATGTCTGAGTTT | 72 | 8387 | 8406 | 906 |
| 544382 | N/A | N/A | AACTAATTCATTATAAGCCA | 56 | 8450 | 8469 | 907 |
| 544383 | N/A | N/A | GCATTGAGTTAACTAATTCA | 78 | 8460 | 8479 | 26 |
| 544385 | N/A | N/A | TTTGGATTTTAAACATCTGT | 73 | 8528 | 8547 | 908 |
| 544386 | N/A | N/A | TGTATGTGCTTTTTGGATTT | 57 | 8539 | 8558 | 909 |
| 544387 | N/A | N/A | CATGGATTTTTGTATGTGCT | 64 | 8549 | 8568 | 910 |
| 544388 | N/A | N/A | TCATTCATGGATTTTTGTAT | 53 | 8554 | 8573 | 911 |
| 544389 | N/A | N/A | ACTTAGACATCATTCATGGA | 66 | 8563 | 8582 | 912 |
| 544390 | N/A | N/A | GTGAGTACTTAGACATCATT | 74 | 8569 | 8588 | 913 |
| 544391 | N/A | N/A | TTTATAAGTGAGTACTTAGA | 32 | 8576 | 8595 | 914 |
| 544392 | N/A | N/A | GTCTTCTACTTTATAAGTGA | 63 | 8585 | 8604 | 915 |
| 544393 | N/A | N/A | ATGAATGTCTTCTACTTTAT | 68 | 8591 | 8610 | 916 |
| 544394 | N/A | N/A | CAAATAGTACTGAGCATTTA | 53 | 8627 | 8646 | 917 |
| 544395 | N/A | N/A | TTAGAAGATTTGGAGCTACA | 55 | 8718 | 8737 | 918 |
| 544396 | N/A | N/A | TCACTATTAGAAGATTTGGA | 60 | 8724 | 8743 | 919 |
| 544397 | N/A | N/A | GGGTTACACTCACTATTAGA | 52 | 8733 | 8752 | 920 |
| 544398 | N/A | N/A | ACTTACCTGTCAGCCTTTA | 61 | 8758 | 8777 | 921 |
| 544399 | N/A | N/A | CTTACCAGAATTAAGTGAGT | 43 | 8785 | 8804 | 922 |
| 544400 | N/A | N/A | AATACAAGTACAAATGGGTT | 29 | 8810 | 8829 | 923 |
| 544401 | N/A | N/A | CTGGTAAATACAAGTACAAA | 76 | 8816 | 8835 | 924 |
| 544402 | N/A | N/A | GGATTGCTGGTAAATACAAG | 59 | 8822 | 8841 | 925 |
| 544403 | N/A | N/A | TCATTTAAGGATTGCTGGT | 63 | 8831 | 8850 | 926 |
| 544404 | N/A | N/A | AGTTAGTAGGAAGCTTCATT | 54 | 8846 | 8865 | 927 |
| 544405 | N/A | N/A | GCTATTGAGTTAGTAGGAAG | 63 | 8853 | 8872 | 928 |
| 544407 | N/A | N/A | AGCATGGTTCTTAATAACTT | 69 | 9012 | 9031 | 929 |
| 544408 | N/A | N/A | CTTTGTAGAAAAAGACAGGA | 45 | 9062 | 9081 | 930 |
| 544409 | N/A | N/A | ACCTGGCCTTTGGTATTTGC | 66 | 9096 | 9115 | 931 |
| 544410 | N/A | N/A | CATCCATATACAGTCAAGAG | 78 | 9174 | 9193 | 27 |
| 544411 | N/A | N/A | AGTCTTTATATGGATAAACT | 46 | 9215 | 9234 | 932 |
| 544412 | N/A | N/A | CGTCATTGGTAGAGGAATAT | 45 | 9240 | 9259 | 933 |

TABLE 131-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544413 | N/A | N/A | GATTATCCTTTCTATAATGC | 45 | 9321 | 9340 | 934 |
| 544414 | N/A | N/A | GTCTTGAATCCCTTGATCAT | 61 | 9436 | 9455 | 935 |
| 544415 | N/A | N/A | GGTGCAACTAATTGAGTTGT | 49 | 9459 | 9478 | 936 |
| 544416 | N/A | N/A | GTGTTTTTTATTGGTGCAAC | 46 | 9471 | 9490 | 937 |
| 544417 | N/A | N/A | ATTCTCCTGAAAAGAAAAGT | 50 | 9544 | 9563 | 938 |
| 544418 | N/A | N/A | ATGCCACCACCAGCCTCCTA | 73 | 10219 | 10238 | 939 |
| 544419 | N/A | N/A | ATATCCTTTAACAAATGGGT | 68 | 11540 | 11559 | 940 |
| 544420 | N/A | N/A | GCACTATATCCTTTAACAAA | 74 | 11545 | 11564 | 941 |
| 544421 | N/A | N/A | ACTTGGGCACTATATCCTTT | 68 | 11551 | 11570 | 942 |
| 544422 | N/A | N/A | GAAACATGTCCTATGAGAGT | 56 | 11918 | 11937 | 943 |
| 544424 | N/A | N/A | TTGAGCACTTTAAGCAAAGT | 15 | 12070 | 12089 | 944 |
| 544425 | N/A | N/A | GGAATTTGAGCACTTTAAGC | 35 | 12075 | 12094 | 945 |
| 544426 | N/A | N/A | TAGATTAGACAACTGTGAGT | 54 | 12101 | 12120 | 946 |
| 544427 | N/A | N/A | AAAATGAAGGTCAAGTTTGA | 45 | 12197 | 12216 | 947 |
| 544428 | N/A | N/A | GTGAAAGCAAAATGAAGGTC | 55 | 12205 | 12224 | 948 |
| 544429 | N/A | N/A | GTATTGTGAAAGCAAAATGA | 54 | 12210 | 12229 | 949 |
| 544430 | N/A | N/A | TGGAGAGTATAGTATTGTGA | 53 | 12221 | 12240 | 950 |
| 544433 | N/A | N/A | GAGATTTACAAGTCAAAAAT | 41 | 2806 | 2825 | 951 |
| 544434 | N/A | N/A | ATTTAACTTTGCTGTATTAT | 29 | 2895 | 2914 | 952 |
| 544435 | N/A | N/A | ATCAATGCTAAATGAAATCA | 34 | 2955 | 2974 | 953 |
| 544436 | N/A | N/A | TATTTTCTGGAGATTATTTT | 24 | 3774 | 3793 | 954 |
| 544437 | N/A | N/A | AAAATGAATATTGGCAATTC | 34 | 4159 | 4178 | 955 |
| 544446 | N/A | N/A | AATGCCTAGAATCAATAAAA | 50 | 7343 | 7362 | 956 |
| 544447 | N/A | N/A | GTAAATATTTGTAGATTAGC | 38 | 8003 | 8022 | 957 |
| 544448 | N/A | N/A | ACAAATGTGTAATTGTTTGA | 43 | 8101 | 8120 | 958 |
| 544449 | N/A | N/A | TACTAACAAATGTGTAATTG | 59 | 8106 | 8125 | 959 |
| 544450 | N/A | N/A | TGATAAGTATATTTAAGAAC | 45 | 8183 | 8202 | 960 |
| 544451 | N/A | N/A | TTAACTTCCAATTAATTGAT | 55 | 8357 | 8376 | 961 |
| 544452 | N/A | N/A | TCTGTTATTTTATCTTGCTT | 67 | 8513 | 8532 | 962 |
| 544453 | N/A | N/A | ATCACAATCCTTTTTATTAA | 39 | 8921 | 8940 | 963 |
| 544454 | N/A | N/A | AGAGACTTGAGTAATAATAA | 43 | 9137 | 9156 | 964 |
| 544455 | N/A | N/A | AACAAAATGAAACATGTCCT | 47 | 11926 | 11945 | 965 |
| 544059 | 23 | 42 | GATTTTCAATTTCAAGCAAC | 74 | 3127 | 3146 | 966 |
| 337459 | 49 | 68 | AGCTTAATTGTGAACATTTT | 77 | 3153 | 3172 | 967 |
| 544060 | 54 | 73 | GAAGGAGCTTAATTGTGAAC | 59 | 3158 | 3177 | 968 |
| 544061 | 63 | 82 | CAATAAAAAGAAGGAGCTTA | 64 | 3167 | 3186 | 969 |
| 544062 | 66 | 85 | GAACAATAAAAAGAAGGAGC | 67 | 3170 | 3189 | 970 |
| 544063 | 85 | 104 | CTGGAGGAAATAACTAGAGG | 49 | 3189 | 3208 | 971 |
| 337460 | 88 | 107 | ATTCTGGAGGAAATAACTAG | 65 | 3192 | 3211 | 972 |
| 544064 | 112 | 131 | TCAAATGATGAATTGTCTTG | 58 | 3216 | 3235 | 973 |
| 544065 | 138 | 157 | TTGATTTTGGCTCTGGAGAT | 67 | 3242 | 3261 | 974 |
| 544066 | 145 | 164 | GCAAATCTTGATTTTGGCTC | 82 | 3249 | 3268 | 975 |
| 233676 | 148 | 167 | ATAGCAAATCTTGATTTTGG | 81 | 3252 | 3271 | 976 |
| 544067 | 156 | 175 | CGTCTAACATAGCAAATCTT | 87 | 3260 | 3279 | 977 |
| 544068 | 174 | 193 | TGGCTAAAATTTTTACATCG | 66 | 3278 | 3297 | 978 |
| 544069 | 178 | 197 | CCATTGGCTAAAATTTTTAC | 41 | 3282 | 3301 | 979 |
| 544070 | 184 | 203 | AGGAGGCCATTGGCTAAAAT | 36 | 3288 | 3307 | 980 |
| 544071 | 187 | 206 | TGAAGGAGGCCATTGGCTAA | 44 | 3291 | 3310 | 981 |
| 544072 | 195 | 214 | GTCCCAACTGAAGGAGGCCA | 59 | 3299 | 3318 | 982 |
| 544073 | 199 | 218 | CCATGTCCCAACTGAAGGAG | 54 | 3303 | 3322 | 983 |
| 544074 | 202 | 221 | AGACCATGTCCCAACTGAAG | 68 | 3306 | 3325 | 984 |
| 544075 | 206 | 225 | TTTAAGACCATGTCCCAACT | 51 | 3310 | 3329 | 985 |
| 544076 | 209 | 228 | GTCTTTAAGACCATGTCCCA | 64 | 3313 | 3332 | 986 |
| 544077 | 216 | 235 | GGACAAAGTCTTTAAGACCA | 45 | 3320 | 3339 | 987 |
| 544078 | 222 | 241 | TCTTATGGACAAAGTCTTTA | 40 | 3326 | 3345 | 988 |
| 544079 | 245 | 264 | TATGTCATTAATTTGGCCCT | 30 | 3349 | 3368 | 989 |
| 544080 | 270 | 289 | GATCAAATATGTTGAGTTTT | 65 | 3374 | 3393 | 990 |
| 233690 | 274 | 293 | GACTGATCAAATATGTTGAG | 75 | 3378 | 3397 | 991 |
| 544081 | 316 | 335 | TCTTCTTTGATTTCACTGGT | 86 | 3420 | 3439 | 992 |
| 544082 | 334 | 353 | CTTCTCAGTTCCTTTTCTTC | 69 | 3438 | 3457 | 993 |
| 544083 | 337 | 356 | GTTCTTCTCAGTTCCTTTTC | 77 | 3441 | 3460 | 994 |
| 544084 | 341 | 360 | TGTAGTTCTTCTCAGTTCCT | 75 | 3445 | 3464 | 995 |
| 544431 | 345 | 364 | TATATGTAGTTCTTCTCAGT | 15 | 3449 | 3468 | 996 |
| 544086 | 348 | 367 | GTTTATATGTAGTTCTTCTC | 65 | 3452 | 3471 | 997 |
| 544087 | 352 | 371 | TGTAGTTTATATGTAGTTCT | 49 | 3456 | 3475 | 998 |
| 544088 | 356 | 375 | GACTTGTAGTTTATATGTAG | 21 | 3460 | 3479 | 999 |
| 544089 | 364 | 383 | TCATTTTTGACTTGTAGTTT | 60 | 3468 | 3487 | 1000 |
| 544090 | 369 | 388 | CCTCTTCATTTTTGACTTGT | 83 | 3473 | 3492 | 1001 |
| 544091 | 375 | 394 | TCTTTACCTCTTCATTTTTG | 75 | 3479 | 3498 | 1002 |
| 544092 | 380 | 399 | CATATTCTTTACCTCTTCAT | 77 | 3484 | 3503 | 1003 |
| 544093 | 384 | 403 | GTGACATATTCTTTACCTCT | 76 | 3488 | 3507 | 1004 |
| 544094 | 392 | 411 | GAGTTCAAGTGACATATTCT | 71 | 3496 | 3515 | 1005 |
| 544095 | 398 | 417 | TGAGTTGAGTTCAAGTGACA | 44 | 3502 | 3521 | 1006 |

TABLE 131-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544096 | 403 | 422 | AGTTTTGAGTTGAGTTCAAG | 33 | 3507 | 3526 | 1007 |
| 544097 | 406 | 425 | TCAAGTTTTGAGTTGAGTTC | 69 | 3510 | 3529 | 1008 |
| 544098 | 414 | 433 | GGAGGCTTTCAAGTTTTGAG | 68 | 3518 | 3537 | 1009 |
| 544099 | 423 | 442 | TTTCTTCTAGGAGGCTTTCA | 79 | 3527 | 3546 | 1010 |
| 544100 | 427 | 446 | ATTTTTTCTTCTAGGAGGCT | 63 | 3531 | 3550 | 1011 |
| 544101 | 432 | 451 | GTAGAATTTTTTCTTCTAGG | 56 | 3536 | 3555 | 1012 |
| 544102 | 462 | 481 | GCTCTTCTAAATATTTCACT | 85 | 3566 | 3585 | 1013 |
| 544103 | 474 | 493 | AGTTAGTTAGTTGCTCTTCT | 71 | 3578 | 3597 | 1014 |
| 544104 | 492 | 511 | CAGGTTGATTTTGAATTAAG | 69 | 3596 | 3615 | 1015 |
| 544105 | 495 | 514 | TTTCAGGTTGATTTTGAATT | 53 | 3599 | 3618 | 1016 |
| 544106 | 499 | 518 | GGAGTTTCAGGTTGATTTTG | 64 | 3603 | 3622 | 1017 |
| 544107 | 504 | 523 | GTTCTGGAGTTTCAGGTTGA | 74 | 3608 | 3627 | 1018 |
| 544108 | 526 | 545 | TTAAGTGAAGTTACTTCTGG | 60 | 3630 | 3649 | 1019 |
| 544109 | 555 | 574 | TGCTATTATCTTGTTTTTCT | 63 | 4293 | 4312 | 1020 |
| 544110 | 564 | 583 | GGTCTTTGATGCTATTATCT | 65 | 4302 | 4321 | 1021 |
| 544111 | 567 | 586 | GAAGGTCTTTGATGCTATTA | 49 | 4305 | 4324 | 1022 |
| 544112 | 572 | 591 | CTGGAGAAGGTCTTTGATGC | 65 | 4310 | 4329 | 1023 |
| 544113 | 643 | 662 | CTGAGCTGATTTTCTATTTC | 64 | N/A | N/A | 1024 |
| 337477 | 664 | 683 | GGTTCTTGAATACTAGTCCT | 82 | 6677 | 6696 | 234 |
| 544114 | 673 | 692 | ATTTCTGTGGGTTCTTGAAT | 57 | 6686 | 6705 | 1025 |
| 337478 | 675 | 694 | AAATTTCTGTGGGTTCTTGA | 29 | 6688 | 6707 | 235 |
| 544115 | 678 | 697 | GAGAAATTTCTGTGGGTTCT | 68 | 6691 | 6710 | 1026 |
| 544116 | 682 | 701 | GATAGAGAAATTTCTGTGGG | 54 | 6695 | 6714 | 1027 |
| 544117 | 689 | 708 | CTTGGAAGATAGAGAAATTT | 36 | 6702 | 6721 | 1028 |
| 337479 | 692 | 711 | TGGCTTGGAAGATAGAGAAA | 54 | 6705 | 6724 | 236 |
| 544118 | 699 | 718 | GTGCTCTTGGCTTGGAAGAT | 64 | 6712 | 6731 | 1029 |
| 544119 | 703 | 722 | CTTGGTGCTCTTGGCTTGGA | 68 | 6716 | 6735 | 1030 |
| 544120 | 707 | 726 | AGTTCTTGGTGCTCTTGGCT | 91 | 6720 | 6739 | 15 |
| 233710 | 710 | 729 | AGTAGTTCTTGGTGCTCTTG | 80 | 6723 | 6742 | 233 |
| 544121 | 713 | 732 | GGGAGTAGTTCTTGGTGCTC | 76 | 6726 | 6745 | 1031 |
| 544122 | 722 | 741 | CTGAAGAAAGGGAGTAGTTC | 55 | 6735 | 6754 | 1032 |
| 544123 | 752 | 771 | ATCATGTTTTACATTTCTTA | 52 | 6765 | 6784 | 1033 |
| 544124 | 755 | 774 | GCCATCATGTTTTACATTTC | 61 | N/A | N/A | 1034 |
| 544125 | 759 | 778 | GAATGCCATCATGTTTTACA | 30 | N/A | N/A | 1035 |
| 544126 | 762 | 781 | CAGGAATGCCATCATGTTTT | 34 | N/A | N/A | 1036 |
| 337487 | 804 | 823 | CACTTGTATGTTCACCTCTG | 83 | 7389 | 7408 | 28 |
| 233717 | 889 | 908 | TGAATTAATGTCCATGGACT | 75 | 7876 | 7895 | 14 |
| 544202 | 2081 | 2100 | AAAGTCAATGTGACTTAGTA | 70 | 11053 | 11072 | 1037 |
| 544203 | 2104 | 2123 | AAGGTATAGTGATACCTCAT | 84 | 11076 | 11095 | 1038 |

TABLE 132

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560535 | N/A | N/A | ACTGTTTTCTTCTGGAAGCA | 0 | 3102 | 3121 | 1039 |
| 560536 | N/A | N/A | AAATAAGGTATAGTGATACC | 0 | 11080 | 11099 | 1040 |
| 560537 | N/A | N/A | ACAAATAAGGTATAGTGATA | 1 | 11082 | 11101 | 1041 |
| 560538 | N/A | N/A | TAACAAATAAGGTATAGTGA | 0 | 11084 | 11103 | 1042 |
| 560539 | N/A | N/A | TTTAACAAATAAGGTATAGT | 16 | 11086 | 11105 | 1043 |
| 560540 | N/A | N/A | ATATATTTTAACAAATAAGG | 0 | 11092 | 11111 | 1044 |
| 560541 | N/A | N/A | CAGTATATATTTTAACAAAT | 0 | 11096 | 11115 | 1045 |
| 560542 | N/A | N/A | TACAGTATATATTTTAACAA | 0 | 11098 | 11117 | 1046 |
| 560543 | N/A | N/A | TATACAGTATATATTTTAAC | 0 | 11100 | 11119 | 1047 |
| 560544 | N/A | N/A | ATAGTATTAAGTGTTAAAAT | 0 | 11130 | 11149 | 1048 |
| 560545 | N/A | N/A | TCATAGTATTAAGTGTTAAA | 0 | 11132 | 11151 | 1049 |
| 560546 | N/A | N/A | GTTTTCATAGTATTAAGTGT | 26 | 11136 | 11155 | 1050 |
| 560547 | N/A | N/A | ATTATTTGTTTTCATAGTAT | 0 | 11143 | 11162 | 1051 |
| 560548 | N/A | N/A | CTTTACAATTATTTGTTTTC | 0 | 11150 | 11169 | 1052 |
| 560549 | N/A | N/A | ATTCCTTTACAATTATTTGT | 21 | 11154 | 11173 | 1053 |
| 560550 | N/A | N/A | AGATTCCTTTACAATTATTT | 18 | 11156 | 11175 | 1054 |
| 560551 | N/A | N/A | CAAGATTCCTTTACAATTAT | 21 | 11158 | 11177 | 1055 |
| 560552 | N/A | N/A | GACAAGATTCCTTTACAATT | 55 | 11160 | 11179 | 1056 |
| 560553 | N/A | N/A | CTGACAAGATTCCTTTACAA | 47 | 11162 | 11181 | 1057 |
| 560554 | N/A | N/A | AATCTGACAAGATTCCTTTA | 52 | 11165 | 11184 | 1058 |
| 560555 | N/A | N/A | GTAATCTGACAAGATTCCTT | 56 | 11167 | 11186 | 1059 |

TABLE 132-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560556 | N/A | N/A | CTGTAATCTGACAAGATTCC | 51 | 11169 | 11188 | 1060 |
| 560557 | N/A | N/A | TACTGTAATCTGACAAGATT | 18 | 11171 | 11190 | 1061 |
| 560558 | N/A | N/A | CTTACTGTAATCTGACAAGA | 33 | 11173 | 11192 | 1062 |
| 560559 | N/A | N/A | TTCTTACTGTAATCTGACAA | 47 | 11175 | 11194 | 1063 |
| 560560 | N/A | N/A | CATTCTTACTGTAATCTGAC | 65 | 11177 | 11196 | 1064 |
| 560561 | N/A | N/A | TTCATTCTTACTGTAATCTG | 54 | 11179 | 11198 | 1065 |
| 560562 | N/A | N/A | TGTTCATTCTTACTGTAATC | 44 | 11181 | 11200 | 1066 |
| 560563 | N/A | N/A | TATGTTCATTCTTACTGTAA | 39 | 11183 | 11202 | 1067 |
| 560564 | N/A | N/A | AATATGTTCATTCTTACTGT | 0 | 11185 | 11204 | 1068 |
| 560565 | N/A | N/A | ACAAATATGTTCATTCTTAC | 3 | 11188 | 11207 | 1069 |
| 560566 | N/A | N/A | CCACAAATATGTTCATTCTT | 75 | 11190 | 11209 | 42 |
| 560567 | N/A | N/A | TGCCACAAATATGTTCATTC | 80 | 11192 | 11211 | 43 |
| 560568 | N/A | N/A | CGATGCCACAAATATGTTCA | 64 | 11195 | 11214 | 1070 |
| 560569 | N/A | N/A | CTCGATGCCACAAATATGTT | 65 | 11197 | 11216 | 1071 |
| 560570 | N/A | N/A | AACTCGATGCCACAAATATG | 46 | 11199 | 11218 | 1072 |
| 560571 | N/A | N/A | TTAACTCGATGCCACAAATA | 52 | 11201 | 11220 | 1073 |
| 560572 | N/A | N/A | CTTTAACTCGATGCCACAAA | 66 | 11203 | 11222 | 1074 |
| 560573 | N/A | N/A | AACTTTAACTCGATGCCACA | 53 | 11205 | 11224 | 1075 |
| 560574 | N/A | N/A | TAAACTTTAACTCGATGCCA | 72 | 11207 | 11226 | 44 |
| 560575 | N/A | N/A | AATATAAACTTTAACTCGAT | 6 | 11211 | 11230 | 1076 |
| 560576 | N/A | N/A | GAAATATAAACTTTAACTCG | 17 | 11213 | 11232 | 1077 |
| 560577 | N/A | N/A | GGGAAATATAAACTTTAACT | 0 | 11215 | 11234 | 1078 |
| 560578 | N/A | N/A | GAATCACAGCATATTTAGGG | 46 | 11233 | 11252 | 1079 |
| 560579 | N/A | N/A | TAGAATCACAGCATATTTAG | 32 | 11235 | 11254 | 1080 |
| 560580 | N/A | N/A | GTATTAGAATCACAGCATAT | 51 | 11239 | 11258 | 1081 |
| 560581 | N/A | N/A | ATGTATTAGAATCACAGCAT | 64 | 11241 | 11260 | 1082 |
| 560582 | N/A | N/A | GAATGTATTAGAATCACAGC | 44 | 11243 | 11262 | 1083 |
| 560583 | N/A | N/A | ACGAATGTATTAGAATCACA | 44 | 11245 | 11264 | 1084 |
| 560584 | N/A | N/A | ACACGAATGTATTAGAATCA | 41 | 11247 | 11266 | 1085 |
| 560585 | N/A | N/A | CTACACGAATGTATTAGAAT | 15 | 11249 | 11268 | 1086 |
| 560586 | N/A | N/A | ACCTACACGAATGTATTAGA | 37 | 11251 | 11270 | 1087 |
| 560587 | N/A | N/A | AAACCTACACGAATGTATTA | 3 | 11253 | 11272 | 1088 |
| 560588 | N/A | N/A | GAAAACCTACACGAATGTAT | 27 | 11255 | 11274 | 1089 |
| 560589 | N/A | N/A | TTGAAAACCTACACGAATGT | 19 | 11257 | 11276 | 1090 |
| 560590 | N/A | N/A | ACTTGAAAACCTACACGAAT | 21 | 11259 | 11278 | 1091 |
| 560591 | N/A | N/A | CTACTTGAAAACCTACACGA | 43 | 11261 | 11280 | 1092 |
| 560592 | N/A | N/A | TATTTCTACTTGAAAACCTA | 29 | 11266 | 11285 | 1093 |
| 560593 | N/A | N/A | TTTATTTCTACTTGAAAACC | 2 | 11268 | 11287 | 1094 |
| 560594 | N/A | N/A | GGTTTATTTCTACTTGAAAA | 27 | 11270 | 11289 | 1095 |
| 560595 | N/A | N/A | GAGGTTTATTTCTACTTGAA | 45 | 11272 | 11291 | 1096 |
| 560596 | N/A | N/A | ACGAGGTTTATTTCTACTTG | 75 | 11274 | 11293 | 45 |
| 560597 | N/A | N/A | TTACGAGGTTTATTTCTACT | 49 | 11276 | 11295 | 1097 |
| 560598 | N/A | N/A | TGTTACGAGGTTTATTTCTA | 39 | 11278 | 11297 | 1098 |
| 560599 | N/A | N/A | CTTGTTACGAGGTTTATTTC | 32 | 11280 | 11299 | 1099 |
| 560600 | N/A | N/A | AACTTGTTACGAGGTTTATT | 27 | 11282 | 11301 | 1100 |
| 560601 | N/A | N/A | GTAACTTGTTACGAGGTTTA | 55 | 11284 | 11303 | 1101 |
| 560602 | N/A | N/A | CAGTAACTTGTTACGAGGTT | 51 | 11286 | 11305 | 1102 |
| 560603 | N/A | N/A | TTCAGTAACTTGTTACGAGG | 40 | 11288 | 11307 | 1103 |
| 560604 | N/A | N/A | CGTTCAGTAACTTGTTACGA | 53 | 11290 | 11309 | 1104 |
| 560605 | N/A | N/A | CTTGTCAGGCTGTTTAAACG | 24 | 11308 | 11327 | 1105 |
| 560606 | N/A | N/A | TGCTTGTCAGGCTGTTTAAA | 46 | 11310 | 11329 | 1106 |
| 560607 | N/A | N/A | CATGCTTGTCAGGCTGTTTA | 72 | 11312 | 11331 | 46 |
| 560608 | N/A | N/A | TACATGCTTGTCAGGCTGTT | 72 | 11314 | 11333 | 47 |
| 560609 | N/A | N/A | TATACATGCTTGTCAGGCTG | 63 | 11316 | 11335 | 1107 |
| 560610 | N/A | N/A | TATATACATGCTTGTCAGGC | 55 | 11318 | 11337 | 1108 |
| 560611 | N/A | N/A | CATATATACATGCTTGTCAG | 47 | 11320 | 11339 | 1109 |
| 560235 | 2 | 21 | TGGAACTGTTTTCTTCTGGA | 43 | 3106 | 3125 | 1110 |
| 337526 | 4 | 23 | CGTGGAACTGTTTTCTTCTG | 54 | 3108 | 3127 | 1111 |
| 560236 | 25 | 44 | TTGATTTTCAATTTCAAGCA | 91 | 3129 | 3148 | 30 |
| 560237 | 27 | 46 | TCTTGATTTTCAATTTCAAG | 33 | 3131 | 3150 | 1112 |
| 560238 | 32 | 51 | TTTTATCTTGATTTTCAATT | 0 | 3136 | 3155 | 1113 |
| 560239 | 35 | 54 | CATTTTTATCTTGATTTTCA | 6 | 3139 | 3158 | 1114 |
| 560240 | 43 | 62 | ATTGTGAACATTTTATCTT | 0 | 3147 | 3166 | 1115 |
| 560241 | 45 | 64 | TAATTGTGAACATTTTTATC | 20 | 3149 | 3168 | 1116 |
| 560242 | 56 | 75 | AAGAAGGAGCTTAATTGTGA | 39 | 3160 | 3179 | 1117 |
| 560243 | 58 | 77 | AAAAGAAGGAGCTTAATTGT | 17 | 3162 | 3181 | 1118 |
| 560244 | 60 | 79 | TAAAAAGAAGGAGCTTAATT | 0 | 3164 | 3183 | 1119 |
| 560245 | 75 | 94 | TAACTAGAGGAACAATAAAA | 37 | 3179 | 3198 | 1120 |
| 560246 | 77 | 96 | AATAACTAGAGGAACAATAA | 3 | 3181 | 3200 | 1121 |
| 560247 | 79 | 98 | GAAATAACTAGAGGAACAAT | 13 | 3183 | 3202 | 1122 |
| 560248 | 81 | 100 | AGGAAATAACTAGAGGAACA | 28 | 3185 | 3204 | 1123 |
| 560249 | 83 | 102 | GGAGGAAATAACTAGAGGAA | 12 | 3187 | 3206 | 1124 |
| 560250 | 90 | 109 | CAATTCTGGAGGAAATAACT | 34 | 3194 | 3213 | 1125 |

TABLE 132-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560251 | 92 | 111 | ATCAATTCTGGAGGAAATAA | 32 | 3196 | 3215 | 1126 |
| 560252 | 96 | 115 | CTTGATCAATTCTGGAGGAA | 15 | 3200 | 3219 | 1127 |
| 560253 | 98 | 117 | GTCTTGATCAATTCTGGAGG | 53 | 3202 | 3221 | 1128 |
| 560254 | 100 | 119 | TTGTCTTGATCAATTCTGGA | 48 | 3204 | 3223 | 1129 |
| 560255 | 102 | 121 | AATTGTCTTGATCAATTCTG | 23 | 3206 | 3225 | 1130 |
| 560256 | 104 | 123 | TGAATTGTCTTGATCAATTC | 14 | 3208 | 3227 | 1131 |
| 560257 | 106 | 125 | GATGAATTGTCTTGATCAAT | 46 | 3210 | 3229 | 1132 |
| 560258 | 108 | 127 | ATGATGAATTGTCTTGATCA | 33 | 3212 | 3231 | 1133 |
| 560259 | 110 | 129 | AAATGATGAATTGTCTTGAT | 24 | 3214 | 3233 | 1134 |
| 560260 | 114 | 133 | AATCAAATGATGAATTGTCT | 25 | 3218 | 3237 | 1135 |
| 560261 | 116 | 135 | AGAATCAAATGATGAATTGT | 16 | 3220 | 3239 | 1136 |
| 560262 | 119 | 138 | TAGAGAATCAAATGATGAAT | 7 | 3223 | 3242 | 1137 |
| 560263 | 126 | 145 | CTGGAGATAGAGAATCAAAT | 40 | 3230 | 3249 | 1138 |
| 560264 | 128 | 147 | CTCTGGAGATAGAGAATCAA | 51 | 3232 | 3251 | 1139 |
| 560265 | 130 | 149 | GGCTCTGGAGATAGAGAATC | 63 | 3234 | 3253 | 31 |
| 560266 | 132 | 151 | TTGGCTCTGGAGATAGAGAA | 49 | 3236 | 3255 | 1140 |
| 560267 | 135 | 154 | ATTTTGGCTCTGGAGATAGA | 49 | 3239 | 3258 | 1141 |
| 560268 | 140 | 159 | TCTTGATTTTGGCTCTGGAG | 69 | 3244 | 3263 | 32 |
| 560269 | 142 | 161 | AATCTTGATTTTGGCTCTGG | 53 | 3246 | 3265 | 1142 |
| 560270 | 150 | 169 | ACATAGCAAATCTTGATTTT | 25 | 3254 | 3273 | 1143 |
| 560271 | 152 | 171 | TAACATAGCAAATCTTGATT | 0 | 3256 | 3275 | 1144 |
| 560272 | 154 | 173 | TCTAACATAGCAAATCTTGA | 53 | 3258 | 3277 | 1145 |
| 560273 | 176 | 195 | ATTGGCTAAAATTTTTACAT | 12 | 3280 | 3299 | 1146 |
| 560274 | 180 | 199 | GGCCATTGGCTAAAATTTTT | 34 | 3284 | 3303 | 1147 |
| 560275 | 182 | 201 | GAGGCCATTGGCTAAAATTT | 26 | 3286 | 3305 | 1148 |
| 560276 | 189 | 208 | ACTGAAGGAGGCCATTGGCT | 51 | 3293 | 3312 | 1149 |
| 560277 | 191 | 210 | CAACTGAAGGAGGCCATTGG | 28 | 3295 | 3314 | 1150 |
| 560278 | 193 | 212 | CCCAACTGAAGGAGGCCATT | 10 | 3297 | 3316 | 1151 |
| 560279 | 197 | 216 | ATGTCCCAACTGAAGGAGGC | 0 | 3301 | 3320 | 1152 |
| 560280 | 204 | 223 | TAAGACCATGTCCCAACTGA | 13 | 3308 | 3327 | 1153 |
| 560281 | 211 | 230 | AAGTCTTTAAGACCATGTCC | 4 | 3315 | 3334 | 1154 |
| 560282 | 213 | 232 | CAAAGTCTTTAAGACCATGT | 24 | 3317 | 3336 | 1155 |
| 560283 | 219 | 238 | TATGGACAAAGTCTTTAAGA | 8 | 3323 | 3342 | 1156 |
| 560284 | 224 | 243 | CGTCTTATGGACAAAGTCTT | 11 | 3328 | 3347 | 1157 |
| 560285 | 242 | 261 | GTCATTAATTTGGCCCTTCG | 57 | 3346 | 3365 | 33 |
| 560286 | 247 | 266 | AATATGTCATTAATTTGGCC | 0 | 3351 | 3370 | 1158 |
| 560287 | 249 | 268 | GAAATATGTCATTAATTTGG | 0 | 3353 | 3372 | 1159 |
| 560288 | 252 | 271 | TTTGAAATATGTCATTAATT | 4 | 3356 | 3375 | 1160 |
| 560289 | 256 | 275 | AGTTTTTGAAATATGTCATT | 7 | 3360 | 3379 | 1161 |
| 560290 | 258 | 277 | TGAGTTTTTGAAATATGTCA | 41 | 3362 | 3381 | 1162 |
| 560291 | 267 | 286 | CAAATATGTTGAGTTTTTGA | 30 | 3371 | 3390 | 1163 |
| 560292 | 272 | 291 | CTGATCAAATATGTTGAGTT | 32 | 3376 | 3395 | 1164 |
| 560293 | 276 | 295 | AAGACTGATCAAATATGTTG | 37 | 3380 | 3399 | 1165 |
| 560294 | 280 | 299 | TAAAAGACTGATCAAATAT | 0 | 3384 | 3403 | 1166 |
| 560295 | 282 | 301 | CATAAAAAGACTGATCAAAT | 6 | 3386 | 3405 | 1167 |
| 560296 | 284 | 303 | ATCATAAAAAGACTGATCAA | 10 | 3388 | 3407 | 1168 |
| 560297 | 287 | 306 | TAGATCATAAAAAGACTGAT | 0 | 3391 | 3410 | 1169 |
| 560298 | 289 | 308 | GATAGATCATAAAAAGACTG | 21 | 3393 | 3412 | 1170 |
| 560299 | 291 | 310 | GCGATAGATCATAAAAAGAC | 20 | 3395 | 3414 | 1171 |
| 560300 | 293 | 312 | CAGCGATAGATCATAAAAAG | 16 | 3397 | 3416 | 1172 |
| 560301 | 295 | 314 | TGCAGCGATAGATCATAAAA | 38 | 3399 | 3418 | 1173 |
| 560302 | 297 | 316 | TTTGCAGCGATAGATCATAA | 32 | 3401 | 3420 | 1174 |
| 560303 | 299 | 318 | GGTTTGCAGCGATAGATCAT | 34 | 3403 | 3422 | 1175 |
| 560304 | 301 | 320 | CTGGTTTGCAGCGATAGATC | 25 | 3405 | 3424 | 1176 |
| 560305 | 303 | 322 | CACTGGTTTGCAGCGATAGA | 28 | 3407 | 3426 | 1177 |
| 560306 | 305 | 324 | TTCACTGGTTTGCAGCGATA | 65 | 3409 | 3428 | 34 |
| 560307 | 307 | 326 | ATTTCACTGGTTTGCAGCGA | 23 | 3411 | 3430 | 1178 |
| 560308 | 310 | 329 | TTGATTTCACTGGTTTGCAG | 5 | 3414 | 3433 | 1179 |
| 560309 | 318 | 337 | CTTCTTCTTTGATTTCACTG | 25 | 3422 | 3441 | 1180 |
| 560310 | 327 | 346 | GTTCCTTTTCTTCTTCTTTG | 19 | 3431 | 3450 | 1181 |
| 544120 | 707 | 726 | AGTTCTTGGTGCTCTTGGCT | 77 | 6720 | 6739 | 15 |
| 560311 | 801 | 820 | TTGTATGTTCACCTCTGTTA | 25 | 7386 | 7405 | 1182 |
| 560312 | 802 | 821 | CTTGTATGTTCACCTCTGTT | 37 | 7387 | 7406 | 1183 |
| 337487 | 804 | 823 | CACTTGTATGTTCACCTCTG | 83 | 73897 | 408 | 28 |
| 560313 | 806 | 825 | GCCACTTGTATGTTCACCTC | 40 | 73917 | 410 | 1184 |
| 560314 | 807 | 826 | TGCCACTTGTATGTTCACCT | 56 | 73927 | 411 | 1185 |
| 560315 | 808 | 827 | ATGCCACTTGTATGTTCACC | 39 | 73937 | 412 | 1186 |
| 337488 | 809 | 828 | CATGCCACTTGTATGTTCAC | 19 | 73947 | 413 | 1187 |
| 560316 | 810 | 829 | ACATGCCACTTGTATGTTCA | 26 | 73957 | 414 | 1188 |
| 560317 | 811 | 830 | TACATGCCACTTGTATGTTC | 20 | 73967 | 415 | 1189 |
| 560318 | 814 | 833 | GCATACATGCCACTTGTATG | 2 | 73997 | 418 | 1190 |
| 560319 | 815 | 834 | GGCATACATGCCACTTGTAT | 24 | 74007 | 419 | 1191 |
| 560320 | 816 | 835 | TGGCATACATGCCACTTGTA | 7 | 74017 | 420 | 1192 |

TABLE 132-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560321 | 817 | 836 | ATGGCATACATGCCACTTGT | 0 | 74027 | 421 | 1193 |
| 560322 | 821 | 840 | TCTGATGGCATACATGCCAC | 26 | 74067 | 425 | 1194 |
| 560323 | 822 | 841 | GTCTGATGGCATACATGCCA | 39 | 74077 | 426 | 1195 |
| 560324 | 824 | 843 | GGGTCTGATGGCATACATGC | 15 | 74097 | 428 | 1196 |
| 560325 | 825 | 844 | TGGGTCTGATGGCATACATG | 23 | 74107 | 429 | 1197 |
| 560326 | 826 | 845 | CTGGGTCTGATGGCATACAT | 9 | 74117 | 430 | 1198 |
| 560327 | 834 | 853 | GAGAGTTGCTGGGTCTGATG | 0 | 74197 | 438 | 1199 |
| 560328 | 835 | 854 | TGAGAGTTGCTGGGTCTGAT | 2 | 74207 | 439 | 1200 |
| 560329 | 836 | 855 | TTGAGAGTTGCTGGGTCTGA | 35 | 74217 | 440 | 1201 |
| 560330 | 837 | 856 | CTTGAGAGTTGCTGGGTCTG | 17 | 74227 | 441 | 1202 |
| 560331 | 838 | 857 | ACTTGAGAGTTGCTGGGTCT | 0 | 74237 | 442 | 1203 |
| 560332 | 839 | 858 | AACTTGAGAGTTGCTGGGTC | 13 | 74247 | 443 | 1204 |
| 560333 | 843 | 862 | GAAAAACTTGAGAGTTGCTG | 22 | 74287 | 447 | 1205 |
| 560334 | 844 | 863 | TGAAAAACTTGAGAGTTGCT | 16 | 74297 | 448 | 1206 |
| 560335 | 845 | 864 | ATGAAAAACTTGAGAGTTGC | 10 | 74307 | 449 | 1207 |
| 560336 | 846 | 865 | CATGAAAAACTTGAGAGTTG | 2 | 74317 | 450 | 1208 |
| 560337 | 851 | 870 | GTAGACATGAAAAACTTGAG | 13 | 74367 | 455 | 1209 |
| 560338 | 853 | 872 | CAGTAGACATGAAAAACTTG | 3 | 74387 | 457 | 1210 |
| 560339 | 861 | 880 | TAACATCACAGTAGACATGA | 30 | 74467 | 465 | 1211 |
| 560340 | 862 | 881 | ATAACATCACAGTAGACATG | 34 | 74477 | 466 | 1212 |
| 560341 | 863 | 882 | TATAACATCACAGTAGACAT | 0 | 74487 | 467 | 1213 |
| 560342 | 864 | 883 | ATATAACATCACAGTAGACA | 10 | 74497 | 468 | 1214 |
| 560343 | 865 | 884 | GATATAACATCACAGTAGAC | 9 | 74507 | 469 | 1215 |
| 560344 | 866 | 885 | TGATATAACATCACAGTAGA | 20 | 74517 | 470 | 1216 |
| 337490 | 867 | 886 | CTGATATAACATCACAGTAG | 24 | 74527 | 471 | 1217 |
| 560345 | 868 | 887 | CCTGATATAACATCACAGTA | 36 | 74537 | 472 | 1218 |
| 560346 | 869 | 888 | ACCTGATATAACATCACAGT | 35 | 74547 | 473 | 1219 |
| 560347 | 870 | 889 | TACCTGATATAACATCACAG | 26 | 74557 | 474 | 1220 |
| 560348 | 871 | 890 | CTACCTGATATAACATCACA | 38 | N/A | N/A | 1221 |
| 560349 | 872 | 891 | ACTACCTGATATAACATCAC | 12 | N/A | N/A | 1222 |
| 560350 | 873 | 892 | GACTACCTGATATAACATCA | 28 | N/A | N/A | 1223 |
| 560351 | 874 | 893 | GGACTACCTGATATAACATC | 15 | N/A | N/A | 1224 |
| 560352 | 875 | 894 | TGGACTACCTGATATAACAT | 0 | N/A | N/A | 1225 |
| 560353 | 876 | 895 | ATGGACTACCTGATATAACA | 11 | N/A | N/A | 1226 |
| 337491 | 877 | 896 | CATGGACTACCTGATATAAC | 3 | N/A | N/A | 1227 |
| 560354 | 878 | 897 | CCATGGACTACCTGATATAA | 0 | N/A | N/A | 1228 |
| 560355 | 879 | 898 | TCCATGGACTACCTGATATA | 13 | N/A | N/A | 1229 |
| 560356 | 880 | 899 | GTCCATGGACTACCTGATAT | 50 | N/A | N/A | 1230 |
| 560357 | 881 | 900 | TGTCCATGGACTACCTGATA | 12 | N/A | N/A | 1231 |
| 560358 | 882 | 901 | ATGTCCATGGACTACCTGAT | 20 | N/A | N/A | 1232 |
| 560359 | 883 | 902 | AATGTCCATGGACTACCTGA | 16 | 7870 | 7889 | 1233 |
| 560360 | 884 | 903 | TAATGTCCATGGACTACCTG | 26 | 7871 | 7890 | 1234 |
| 560361 | 885 | 904 | TTAATGTCCATGGACTACCT | 31 | 7872 | 7891 | 1235 |
| 560362 | 886 | 905 | ATTAATGTCCATGGACTACC | 42 | 7873 | 7892 | 1236 |
| 560363 | 887 | 906 | AATTAATGTCCATGGACTAC | 21 | 7874 | 7893 | 1237 |
| 560364 | 891 | 910 | GTTGAATTAATGTCCATGGA | 18 | 7878 | 7897 | 1238 |
| 560365 | 892 | 911 | TGTTGAATTAATGTCCATGG | 36 | 7879 | 7898 | 1239 |
| 560366 | 893 | 912 | ATGTTGAATTAATGTCCATG | 13 | 7880 | 7899 | 1240 |
| 560367 | 894 | 913 | GATGTTGAATTAATGTCCAT | 14 | 7881 | 7900 | 1241 |
| 560368 | 895 | 914 | CGATGTTGAATTAATGTCCA | 30 | 7882 | 7901 | 1242 |
| 560369 | 896 | 915 | TCGATGTTGAATTAATGTCC | 29 | 7883 | 7902 | 1243 |
| 560370 | 897 | 916 | TTCGATGTTGAATTAATGTC | 4 | 7884 | 7903 | 1244 |
| 560371 | 898 | 917 | ATTCGATGTTGAATTAATGT | 22 | 7885 | 7904 | 1245 |
| 560372 | 899 | 918 | TATTCGATGTTGAATTAATG | 0 | 7886 | 7905 | 1246 |
| 560373 | 900 | 919 | CTATTCGATGTTGAATTAAT | 0 | 7887 | 7906 | 1247 |
| 337492 | 901 | 920 | TCTATTCGATGTTGAATTAA | 59 | 7888 | 7907 | 29 |
| 560374 | 902 | 921 | ATCTATTCGATGTTGAATTA | 18 | 7889 | 7908 | 1248 |
| 560375 | 903 | 922 | CATCTATTCGATGTTGAATT | 27 | 7890 | 7909 | 1249 |
| 560376 | 904 | 923 | CCATCTATTCGATGTTGAAT | 40 | 7891 | 7910 | 1250 |
| 560377 | 905 | 924 | TCCATCTATTCGATGTTGAA | 23 | 7892 | 7911 | 1251 |
| 560378 | 906 | 925 | ATCCATCTATTCGATGTTGA | 47 | 7893 | 7912 | 1252 |
| 560379 | 907 | 926 | GATCCATCTATTCGATGTTG | 46 | 7894 | 7913 | 1253 |
| 560380 | 908 | 927 | TGATCCATCTATTCGATGTT | 16 | 7895 | 7914 | 1254 |
| 560381 | 909 | 928 | GTGATCCATCTATTCGATGT | 24 | 7896 | 7915 | 1255 |
| 560382 | 910 | 929 | TGTGATCCATCTATTCGATG | 21 | 7897 | 7916 | 1256 |
| 560383 | 911 | 930 | TTGTGATCCATCTATTCGAT | 19 | 7898 | 7917 | 1257 |
| 560384 | 1273 | 1292 | TTTAGGTTGTTTTCTCCACA | 35 | 10245 | 10264 | 1258 |
| 560385 | 1274 | 1293 | ATTTAGGTTGTTTTCTCCAC | 34 | 10246 | 10265 | 1259 |
| 560386 | 1278 | 1297 | TACCATTTAGGTTGTTTTCT | 15 | 10250 | 10269 | 1260 |
| 560387 | 1286 | 1305 | GTTATATTTACCATTTAGGT | 20 | 10258 | 10277 | 1261 |
| 560388 | 1287 | 1306 | TGTTATATTTACCATTTAGG | 17 | 10259 | 10278 | 1262 |
| 560389 | 1288 | 1307 | TTGTTATATTTACCATTTAG | 21 | 10260 | 10279 | 1263 |
| 560390 | 1289 | 1308 | TTTGTTATATTTACCATTTA | 4 | 10261 | 10280 | 1264 |

TABLE 132-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560391 | 1292 | 1311 | TGGTTTGTTATATTTACCAT | 23 | 10264 | 10283 | 1265 |
| 560392 | 1296 | 1315 | CTCTTGGTTTGTTATATTTA | 63 | 10268 | 10287 | 1266 |
| 560393 | 1297 | 1316 | GCTCTTGGTTTGTTATATTT | 61 | 10269 | 10288 | 1267 |
| 560394 | 1298 | 1317 | TGCTCTTGGTTTGTTATATT | 51 | 10270 | 10289 | 1268 |
| 560395 | 1301 | 1320 | TTTTGCTCTTGGTTTGTTAT | 2 | 10273 | 10292 | 1269 |
| 560396 | 1302 | 1321 | ATTTTGCTCTTGGTTTGTTA | 0 | 10274 | 10293 | 1270 |
| 560397 | 1303 | 1322 | GATTTTGCTCTTGGTTTGTT | 0 | 10275 | 10294 | 1271 |
| 560398 | 1304 | 1323 | AGATTTTGCTCTTGGTTTGT | 16 | 10276 | 10295 | 1272 |
| 560399 | 1305 | 1324 | TAGATTTTGCTCTTGGTTTG | 28 | 10277 | 10296 | 1273 |
| 560400 | 1307 | 1326 | CTTAGATTTTGCTCTTGGTT | 69 | 10279 | 10298 | 35 |
| 560401 | 1308 | 1327 | GCTTAGATTTTGCTCTTGGT | 77 | 10280 | 10299 | 36 |
| 560402 | 1309 | 1328 | GGCTTAGATTTTGCTCTTGG | 72 | 10281 | 10300 | 37 |
| 560403 | 1315 | 1334 | CTCTCTGGCTTAGATTTTGC | 38 | 10287 | 10306 | 1274 |
| 560404 | 1316 | 1335 | CCTCTCTGGCTTAGATTTTG | 49 | 10288 | 10307 | 1275 |
| 560405 | 1317 | 1336 | TCCTCTCTGGCTTAGATTTT | 46 | 10289 | 10308 | 1276 |
| 560406 | 1321 | 1340 | CTTCCTCTCTGGCTTAGA | 40 | 10293 | 10312 | 1277 |
| 560407 | 1322 | 1341 | TCTTCCTCTCTGGCTTAG | 57 | 10294 | 10313 | 1278 |
| 560408 | 1323 | 1342 | CTCTTCCTCTCTGGCTTA | 40 | 10295 | 10314 | 1279 |
| 337505 | 1328 | 1347 | TAATCCTCTTCTCCTCTG | 28 | 10300 | 10319 | 1280 |
| 560409 | 1329 | 1348 | ATAATCCTCTTCTCCTCT | 30 | 10301 | 10320 | 1281 |
| 560410 | 1330 | 1349 | GATAATCCTCTTCTCCTCTC | 9 | 10302 | 10321 | 1282 |
| 560411 | 1331 | 1350 | AGATAATCCTCTTCTCCTCT | 23 | 10303 | 10322 | 1283 |
| 560412 | 1332 | 1351 | AAGATAATCCTCTTCTCCTC | 12 | 10304 | 10323 | 1284 |
| 560413 | 1333 | 1352 | CAAGATAATCCTCTTCTCCT | 40 | 10305 | 10324 | 1285 |
| 560414 | 1334 | 1353 | CCAAGATAATCCTCTTCTCC | 52 | 10306 | 10325 | 1286 |
| 560415 | 1335 | 1354 | TCCAAGATAATCCTCTTCTC | 56 | 10307 | 10326 | 1287 |
| 560416 | 1336 | 1355 | TTCCAAGATAATCCTCTTCT | 60 | 10308 | 10327 | 1288 |
| 560417 | 1337 | 1356 | CTTCCAAGATAATCCTCTTC | 58 | 10309 | 10328 | 1289 |
| 560418 | 1338 | 1357 | ACTTCCAAGATAATCCTCTT | 31 | 10310 | 10329 | 1290 |
| 560419 | 1339 | 1358 | GACTTCCAAGATAATCCTCT | 52 | 10311 | 10330 | 1291 |
| 560420 | 1340 | 1359 | AGACTTCCAAGATAATCCTC | 49 | 10312 | 10331 | 1292 |
| 560421 | 1341 | 1360 | GAGACTTCCAAGATAATCCT | 56 | 10313 | 10332 | 1293 |
| 337506 | 1342 | 1361 | TGAGACTTCCAAGATAATCC | 49 | 10314 | 10333 | 1294 |
| 560422 | 1343 | 1362 | TTGAGACTTCCAAGATAATC | 34 | 10315 | 10334 | 1295 |
| 560423 | 1344 | 1363 | TTTGAGACTTCCAAGATAAT | 14 | 10316 | 10335 | 1296 |
| 560424 | 1345 | 1364 | TTTTGAGACTTCCAAGATAA | 27 | 10317 | 10336 | 1297 |
| 560425 | 1346 | 1365 | ATTTTGAGACTTCCAAGATA | 23 | 10318 | 10337 | 1298 |
| 560426 | 1348 | 1367 | CCATTTTGAGACTTCCAAGA | 40 | 10320 | 10339 | 1299 |
| 560427 | 1351 | 1370 | CTTCCATTTTGAGACTTCCA | 58 | 10323 | 10342 | 1300 |
| 560428 | 1355 | 1374 | TAACCTTCCATTTTGAGACT | 36 | 10327 | 10346 | 1301 |
| 560429 | 1356 | 1375 | ATAACCTTCCATTTTGAGAC | 51 | 10328 | 10347 | 1302 |
| 560430 | 1357 | 1376 | TATAACCTTCCATTTTGAGA | 33 | 10329 | 10348 | 1303 |
| 560431 | 1358 | 1377 | GTATAACCTTCCATTTTGAG | 53 | 10330 | 10349 | 1304 |
| 337508 | 1360 | 1379 | GAGTATAACCTTCCATTTTG | 28 | 10332 | 10351 | 1305 |
| 560432 | 1361 | 1380 | AGAGTATAACCTTCCATTTT | 50 | 10333 | 10352 | 1306 |
| 560433 | 1365 | 1384 | TTATAGAGTATAACCTTCCA | 63 | 10337 | 10356 | 1307 |
| 560434 | 1369 | 1388 | GATTTTATAGAGTATAACCT | 31 | 10341 | 10360 | 1308 |
| 560435 | 1370 | 1389 | TGATTTATAGAGTATAACC | 6 | 10342 | 10361 | 1309 |
| 560436 | 1371 | 1390 | TTGATTTATAGAGTATAAC | 14 | 10343 | 1036 | 1310 |
| 560437 | 1372 | 1391 | GTTGATTTATAGAGTATAA | 2 | 10344 | 10363 | 1311 |
| 560438 | 1376 | 1395 | TTTGGTTGATTTATAGAGT | 20 | 10348 | 10367 | 1312 |
| 560439 | 1386 | 1405 | GGATCAACATTTTGGTTGAT | 42 | 10358 | 10377 | 1313 |
| 560440 | 1387 | 1406 | TGGATCAACATTTTGGTTGA | 10 | 10359 | 10378 | 1314 |
| 560441 | 1388 | 1407 | ATGGATCAACATTTTGGTTG | 34 | 10360 | 10379 | 1315 |
| 560442 | 1398 | 1417 | AATCTGTTGGATGGATCAAC | 52 | 10370 | 10389 | 1316 |
| 560443 | 1399 | 1418 | GAATCTGTTGGATGGATCAA | 47 | 10371 | 10390 | 1317 |
| 560444 | 1403 | 1422 | TTCTGAATCTGTTGGATGGA | 30 | 10375 | 10394 | 1318 |
| 560445 | 1404 | 1423 | TTTCTGAATCTGTTGGATGG | 34 | 10376 | 10395 | 1319 |
| 560446 | 1405 | 1424 | CTTTCTGAATCTGTTGGATG | 50 | 10377 | 10396 | 1320 |
| 560447 | 1409 | 1428 | AAAGCTTTCTGAATCTGTT | 29 | 10381 | 10400 | 1321 |
| 560448 | 1425 | 1444 | TTGCCTCAGTTCATTCAAAG | 38 | 10397 | 10416 | 1322 |
| 560449 | 1429 | 1448 | AAATTTGCCTCAGTTCATTC | 27 | 10401 | 10420 | 1323 |
| 560450 | 1434 | 1453 | CTTTTAAATTGCCTCAGTT | 34 | 10406 | 10425 | 1324 |
| 560451 | 1440 | 1459 | TATTGCCTTTTAAATTTGCC | 21 | 10412 | 10431 | 1325 |
| 560452 | 1441 | 1460 | TTATTGCCTTTTAAATTTGC | 23 | 10413 | 10432 | 1326 |
| 560453 | 1446 | 1465 | TTAAATTATTGCCTTTTAAA | 1 | 10418 | 10437 | 1327 |
| 560454 | 1447 | 1466 | TTTAAATTATTGCCTTTTAA | 1 | 10419 | 10438 | 1328 |
| 560455 | 1448 | 1467 | GTTTAAATTATTGCCTTTTA | 48 | 10420 | 10439 | 1329 |
| 560456 | 1449 | 1468 | TGTTTAAATTATTGCCTTTT | 25 | 10421 | 10440 | 1330 |
| 560457 | 1450 | 1469 | ATGTTTAAATTATTGCCTTT | 0 | 10422 | 10441 | 1331 |
| 560458 | 1704 | 1723 | TTTAATAAGTTCACCTATTG | 26 | 10676 | 10695 | 1332 |
| 560459 | 1705 | 1724 | ATTAATAAGTTCACCTATT | 26 | 10677 | 10696 | 1333 |
| 560460 | 1706 | 1725 | TATTTAATAAGTTCACCTAT | 16 | 10678 | 10697 | 1334 |

TABLE 132-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560461 | 1707 | 1726 | TTATTTAATAAGTTCACCTA | 4 | 10679 | 10698 | 1335 |
| 560462 | 1708 | 1727 | GTTATTTAATAAGTTCACCT | 36 | 10680 | 10699 | 1336 |
| 560463 | 1709 | 1728 | AGTTATTTAATAAGTTCACC | 0 | 10681 | 10700 | 1337 |
| 560464 | 1712 | 1731 | AAAAGTTATTTAATAAGTTC | 12 | 10684 | 10703 | 1338 |
| 560465 | 1719 | 1738 | TATTTAGAAAAGTTATTTAA | 0 | 10691 | 10710 | 1339 |
| 560466 | 1738 | 1757 | TAAAAGTCTCTAAATTTTTT | 0 | 10710 | 10729 | 1340 |
| 560467 | 1739 | 1758 | ATAAAAGTCTCTAAATTTTT | 0 | 10711 | 10730 | 1341 |
| 560468 | 1740 | 1759 | AATAAAAGTCTCTAAATTTT | 25 | 10712 | 10731 | 1342 |
| 560469 | 1760 | 1779 | GCTCATATGATGCCTTTTAA | 77 | 10732 | 10751 | 38 |
| 560470 | 1761 | 1780 | AGCTCATATGATGCCTTTTA | 73 | 10733 | 10752 | 39 |
| 560471 | 1762 | 1781 | TAGCTCATATGATGCCTTTT | 67 | 10734 | 10753 | 40 |
| 560472 | 1763 | 1782 | TTAGCTCATATGATGCCTTT | 42 | 10735 | 10754 | 1343 |
| 560473 | 1764 | 1783 | ATTAGCTCATATGATGCCTT | 61 | 10736 | 10755 | 1344 |
| 560474 | 1765 | 1784 | TATTAGCTCATATGATGCCT | 55 | 10737 | 10756 | 41 |
| 560475 | 1766 | 1785 | ATATTAGCTCATATGATGCC | 42 | 10738 | 10757 | 1345 |
| 560476 | 1767 | 1786 | GATATTAGCTCATATGATGC | 36 | 10739 | 10758 | 1346 |
| 560477 | 1768 | 1787 | TGATATTAGCTCATATGATG | 21 | 10740 | 10759 | 1347 |
| 560478 | 1769 | 1788 | GTGATATTAGCTCATATGAT | 40 | 10741 | 10760 | 1348 |
| 560479 | 1776 | 1795 | GAAAGTTGTGATATTAGCTC | 43 | 10748 | 10767 | 1349 |
| 560480 | 1777 | 1796 | GGAAAGTTGTGATATTAGCT | 19 | 10749 | 10768 | 1350 |
| 560481 | 1778 | 1797 | GGGAAAGTTGTGATATTAGC | 17 | 10750 | 10769 | 1351 |
| 560482 | 1779 | 1798 | TGGGAAAGTTGTGATATTAG | 29 | 10751 | 10770 | 1352 |
| 560483 | 1780 | 1799 | CTGGGAAAGTTGTGATATTA | 35 | 10752 | 10771 | 1353 |
| 560484 | 1781 | 1800 | ACTGGGAAAGTTGTGATATT | 25 | 10753 | 10772 | 1354 |
| 560485 | 1782 | 1801 | AACTGGGAAAGTTGTGATAT | 12 | 10754 | 10773 | 1355 |
| 560486 | 1783 | 1802 | AAACTGGGAAAGTTGTGATA | 21 | 10755 | 10774 | 1356 |
| 560487 | 1784 | 1803 | TAAACTGGGAAAGTTGTGAT | 22 | 10756 | 10775 | 1357 |
| 560488 | 1785 | 1804 | TTAAACTGGGAAAGTTGTGA | 12 | 10757 | 10776 | 1358 |
| 560489 | 1786 | 1805 | TTTAAACTGGGAAAGTTGTG | 22 | 10758 | 10777 | 1359 |
| 560490 | 1787 | 1806 | TTTTAAACTGGGAAAGTTGT | 23 | 10759 | 10778 | 1360 |
| 560491 | 1790 | 1809 | GTTTTTTAAACTGGGAAAGT | 1 | 10762 | 10781 | 1361 |
| 560492 | 1791 | 1810 | AGTTTTTTAAACTGGGAAAG | 0 | 10763 | 10782 | 1362 |
| 560493 | 1792 | 1811 | TAGTTTTTTAAACTGGGAAA | 0 | 10764 | 10783 | 1363 |
| 560494 | 1796 | 1815 | GTACTAGTTTTTTAAACTGG | 23 | 10768 | 10787 | 1364 |
| 560495 | 1799 | 1818 | AGAGTACTAGTTTTTTAAAC | 0 | 10771 | 10790 | 1365 |
| 560496 | 1801 | 1820 | CAAGAGTACTAGTTTTTTAA | 0 | 10773 | 10792 | 1366 |
| 560497 | 1806 | 1825 | TTTAACAAGAGTACTAGTTT | 21 | 10778 | 10797 | 1367 |
| 560498 | 1807 | 1826 | TTTTAACAAGAGTACTAGTT | 19 | 10779 | 10798 | 1368 |
| 560499 | 1808 | 1827 | GTTTTAACAAGAGTACTAGT | 37 | 10780 | 10799 | 1369 |
| 560500 | 1809 | 1828 | AGTTTTAACAAGAGTACTAG | 20 | 10781 | 10800 | 1370 |
| 560501 | 1810 | 1829 | GAGTTTTAACAAGAGTACTA | 21 | 10782 | 10801 | 1371 |
| 560502 | 1811 | 1830 | AGAGTTTTAACAAGAGTACT | 0 | 10783 | 10802 | 1372 |
| 560503 | 1814 | 1833 | TTTAGAGTTTTAACAAGAGT | 0 | 10786 | 10805 | 1373 |
| 560504 | 1815 | 1834 | GTTTAGAGTTTTAACAAGAG | 18 | 10787 | 10806 | 1374 |
| 560505 | 1817 | 1836 | AAGTTTAGAGTTTTAACAAG | 9 | 10789 | 10808 | 1375 |
| 560506 | 1818 | 1837 | CAAGTTTAGAGTTTTAACAA | 1 | 10790 | 10809 | 1376 |
| 560507 | 1822 | 1841 | TAGTCAAGTTTAGAGTTTTA | 21 | 10794 | 10813 | 1377 |
| 560508 | 1823 | 1842 | TTAGTCAAGTTTAGAGTTTT | 10 | 10795 | 10814 | 1378 |
| 560509 | 1824 | 1843 | TTTAGTCAAGTTTAGAGTTT | 20 | 10796 | 10815 | 1379 |
| 560510 | 1828 | 1847 | TGTATTTAGTCAAGTTTAGA | 8 | 10800 | 10819 | 1380 |
| 560511 | 1829 | 1848 | CTGTATTTAGTCAAGTTTAG | 37 | 10801 | 10820 | 1381 |
| 560512 | 1830 | 1849 | TCTGTATTTAGTCAAGTTTA | 46 | 10802 | 10821 | 1382 |
| 560513 | 1834 | 1853 | GTCCTCTGTATTTAGTCAAG | 38 | 10806 | 10825 | 1383 |
| 560514 | 1835 | 1854 | AGTCCTCTGTATTTAGTCAA | 29 | 10807 | 10826 | 1384 |
| 560515 | 1836 | 1855 | CAGTCCTCTGTATTTAGTCA | 47 | 10808 | 10827 | 1385 |
| 560516 | 1837 | 1856 | CCAGTCCTCTGTATTTAGTC | 31 | 10809 | 10828 | 1386 |
| 560517 | 1838 | 1857 | ACCAGTCCTCTGTATTTAGT | 31 | 10810 | 10829 | 1387 |
| 560518 | 1839 | 1858 | TACCAGTCCTCTGTATTTAG | 35 | 10811 | 10830 | 1388 |
| 560519 | 1840 | 1859 | TTACCAGTCCTCTGTATTTA | 30 | 10812 | 10831 | 1389 |
| 560520 | 1841 | 1860 | ATTACCAGTCCTCTGTATTT | 37 | 10813 | 10832 | 1390 |
| 560521 | 1842 | 1861 | AATTACCAGTCCTCTGTATT | 12 | 10814 | 10833 | 1391 |
| 560522 | 1843 | 1862 | CAATTACCAGTCCTCTGTAT | 38 | 10815 | 10834 | 1392 |
| 560523 | 1844 | 1863 | ACAATTACCAGTCCTCTGTA | 35 | 10816 | 10835 | 1393 |
| 560524 | 1845 | 1864 | TACAATTACCAGTCCTCTGT | 51 | 10817 | 10836 | 1394 |
| 560525 | 1846 | 1865 | GTACAATTACCAGTCCTCTG | 52 | 10818 | 10837 | 1395 |
| 560526 | 1847 | 1866 | TGTACAATTACCAGTCCTCT | 38 | 10819 | 10838 | 1396 |
| 560527 | 1848 | 1867 | CTGTACAATTACCAGTCCTC | 19 | 10820 | 10839 | 1397 |
| 560528 | 1849 | 1868 | ACTGTACAATTACCAGTCCT | 13 | 10821 | 10840 | 1398 |
| 560529 | 1850 | 1869 | AACTGTACAATTACCAGTCC | 27 | 10822 | 10841 | 1399 |
| 560530 | 1851 | 1870 | GAACTGTACAATTACCAGTC | 20 | 10823 | 10842 | 1400 |
| 560531 | 1852 | 1871 | AGAACTGTACAATTACCAGT | 24 | 10824 | 10843 | 1401 |
| 560532 | 1854 | 1873 | TAAGAACTGTACAATTACCA | 22 | 10826 | 10845 | 1402 |

TABLE 132-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560533 | 1855 | 1874 | TTAAGAACTGTACAATTACC | 20 | 10827 | 10846 | 1403 |
| 560534 | 1856 | 1875 | TTTAAGAACTGTACAATTAC | 1 | 10828 | 10847 | 1404 |

TABLE 133

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544355 | N/A | N/A | TTTCAGCATGTATCTCTTAA | 69 | 7065 | 7084 | 21 |
| 544376 | N/A | N/A | GGAGTGGTTCTTTTCACAGC | 64 | 8298 | 8317 | 24 |
| 544380 | N/A | N/A | TGGTCCTTTTAACTTCCAAT | 50 | 8365 | 8384 | 25 |
| 560612 | N/A | N/A | ACTTGAAATTATAATAGGAA | 0 | 3798 | 3817 | 1405 |
| 560613 | N/A | N/A | AAAAAACTAACTTGAAATTA | 0 | 3807 | 3826 | 1406 |
| 560614 | N/A | N/A | GAAACAAAAAACTAACTTGA | 21 | 3812 | 3831 | 1407 |
| 560615 | N/A | N/A | GTGTTTTCATATATAACATT | 19 | 3835 | 3854 | 1408 |
| 560616 | N/A | N/A | AATTTTCAGTGTTTTCATAT | 0 | 3843 | 3862 | 1409 |
| 560617 | N/A | N/A | AAAATGCAAATTTTCAGTGT | 0 | 3851 | 3870 | 1410 |
| 560618 | N/A | N/A | GTAATTTTCATATAAAATGC | 0 | 3864 | 3883 | 1411 |
| 560619 | N/A | N/A | GATTTGTAATTTTCATATAA | 0 | 3869 | 3888 | 1412 |
| 560620 | N/A | N/A | TAACCGATTTGTAATTTTCA | 16 | 3874 | 3893 | 1413 |
| 560621 | N/A | N/A | TAATTTAACCGATTTGTAAT | 5 | 3879 | 3898 | 1414 |
| 560622 | N/A | N/A | TTGTATAATTTAACCGATTT | 13 | 3884 | 3903 | 1415 |
| 560623 | N/A | N/A | CTAGATTGTATAATTTAACC | 8 | 3889 | 3908 | 1416 |
| 560624 | N/A | N/A | GTGTTCTAGATTGTATAATT | 24 | 3894 | 3913 | 1417 |
| 560625 | N/A | N/A | AATGACATAGTGTTCTAGAT | 0 | 3903 | 3922 | 1418 |
| 560626 | N/A | N/A | AGTGTAATGACATAGTGTTC | 10 | 3908 | 3927 | 1419 |
| 560627 | N/A | N/A | TTACAATAGTGTAATGACAT | 0 | 3915 | 3934 | 1420 |
| 560628 | N/A | N/A | TTCAGTAATTTACAATAGTG | 12 | 3924 | 3943 | 1421 |
| 560629 | N/A | N/A | TTACCTTCAGTAATTTACAA | 9 | 3929 | 3948 | 1422 |
| 560630 | N/A | N/A | TTAACTTTTTACTTACCTTC | 7 | 3941 | 3960 | 1423 |
| 560631 | N/A | N/A | GAATAGTTTTAAATTTTTTT | 0 | 3960 | 3979 | 1424 |
| 560632 | N/A | N/A | ACACTGGAGAATAGTTTTAA | 10 | 3968 | 3987 | 1425 |
| 560633 | N/A | N/A | TTTAAACACTGGAGAATAGT | 0 | 3973 | 3992 | 1426 |
| 560634 | N/A | N/A | TCTGTTTTAAACACTGGAGA | 25 | 3978 | 3997 | 1427 |
| 560635 | N/A | N/A | GTATTATTTAATCTGTTTTA | 0 | 3989 | 4008 | 1428 |
| 560636 | N/A | N/A | TTACTGTATTATTTAATCTG | 5 | 3994 | 4013 | 1429 |
| 560637 | N/A | N/A | TAAATCTTTTCCATTTACTG | 18 | 4008 | 4027 | 1430 |
| 560638 | N/A | N/A | ATGAATAAATCTTTTCCATT | 12 | 4013 | 4032 | 1431 |
| 560639 | N/A | N/A | GCATATTTTCATATGAATAA | 9 | 4025 | 4044 | 1432 |
| 560640 | N/A | N/A | GCCCAGCATATTTTCATATG | 20 | 4030 | 4049 | 1433 |
| 560641 | N/A | N/A | AAAAGAAAAAGCCCAGCATA | 20 | 4040 | 4059 | 1434 |
| 560642 | N/A | N/A | CTGAACTTCAATTAAAAGAA | 5 | 4053 | 4072 | 1435 |
| 560643 | N/A | N/A | GATTTTCTGAACTTCAATTA | 9 | 4059 | 4078 | 1436 |
| 560644 | N/A | N/A | TCTAAAATTTGATTTTCTGA | 0 | 4069 | 4088 | 1437 |
| 560645 | N/A | N/A | ACTATCTCTAAAATTTGATT | 8 | 4075 | 4094 | 1438 |
| 560646 | N/A | N/A | TTAAATTGTACTATCTCTAA | 5 | 4084 | 4103 | 1439 |
| 560647 | N/A | N/A | ACATTTATTTAAATTGTAC | 17 | 4093 | 4112 | 1440 |
| 560648 | N/A | N/A | GTCCTTAACATTTTATTTAA | 0 | 4100 | 4119 | 1441 |
| 560649 | N/A | N/A | CATATTTTTGTCCTTAACAT | 0 | 4109 | 4128 | 1442 |
| 560650 | N/A | N/A | TAGCACATATTTTTGTCCTT | 25 | 4114 | 4133 | 1443 |
| 560651 | N/A | N/A | TCAAATAGCACATATTTTTG | 0 | 4119 | 4138 | 1444 |
| 560652 | N/A | N/A | CTTCTTTCAAATAGCACATA | 41 | 4125 | 4144 | 1445 |
| 560653 | N/A | N/A | CTTGTATGCTTCTTTCAAAT | 19 | 4133 | 4152 | 1446 |
| 560654 | N/A | N/A | ATTCCTTCCCCTTGTATGCT | 12 | 4143 | 4162 | 1447 |
| 560655 | N/A | N/A | TTGGCAATTCCTTCCCCTTG | 36 | 4149 | 4168 | 1448 |
| 560656 | N/A | N/A | GAATATTGGCAATTCCTTCC | 38 | 4154 | 4173 | 1449 |
| 560657 | N/A | N/A | TGAAAAATGAATATTGGCAA | 0 | 4162 | 4181 | 1450 |
| 560658 | N/A | N/A | TAATGGATTTGAAAAATGAA | 0 | 4171 | 4190 | 1451 |
| 560659 | N/A | N/A | ACTAATAATGGATTTGAAAA | 1 | 4176 | 4195 | 1452 |
| 560660 | N/A | N/A | CATAATCTAAATTTTTAAAC | 6 | 4194 | 4213 | 1453 |
| 560661 | N/A | N/A | CACTATCATAATCTAAATTT | 4 | 4200 | 4219 | 1454 |
| 560662 | N/A | N/A | AATTTCCTGTAACACTATCA | 2 | 4212 | 4231 | 1455 |
| 560663 | N/A | N/A | CTATTAATTCCTGTAACAC | 9 | 4217 | 4236 | 1456 |
| 560664 | N/A | N/A | CTTTTCTATTAATTTCCTGT | 5 | 4222 | 4241 | 1457 |
| 560665 | N/A | N/A | CTCTTTCTTTTCTATTAATT | 0 | 4228 | 4247 | 1458 |

TABLE 133-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560666 | N/A | N/A | AGTTGCTTTCCTCTTTCTTT | 0 | 4238 | 4257 | 1459 |
| 560667 | N/A | N/A | TTATAAGTTGCTTTCCTCTT | 10 | 4243 | 4262 | 1460 |
| 560668 | N/A | N/A | GTTGGTTATAAGTTGCTTTC | 6 | 4248 | 4267 | 1461 |
| 560669 | N/A | N/A | AGTAGGTTGGTTATAAGTTG | 4 | 4253 | 4272 | 1462 |
| 560670 | N/A | N/A | TAGAGAGTAGGTTGGTTATA | 0 | 4258 | 4277 | 1463 |
| 560671 | N/A | N/A | GGATATAGAGAGTAGGTTGG | 0 | 4263 | 4282 | 1464 |
| 560672 | N/A | N/A | AGTCTGGATATAGAGAGTAG | 0 | 4268 | 4287 | 1465 |
| 560673 | N/A | N/A | TACAAAAGTCTGGATATAGA | 7 | 4274 | 4293 | 1466 |
| 560674 | N/A | N/A | GTTTTTCTACAAAAGTCTGG | 12 | 4281 | 4300 | 1467 |
| 560675 | N/A | N/A | TTACCTGATTTTCTATTTCT | 15 | 4380 | 4399 | 1468 |
| 560676 | N/A | N/A | ATACTGACTTACCTGATTTT | 15 | 4388 | 4407 | 1469 |
| 560677 | N/A | N/A | TTAAAATACTGACTTACCTG | 2 | 4393 | 4412 | 1470 |
| 560678 | N/A | N/A | TACCATTAAAATACTGACTT | 0 | 4398 | 4417 | 1471 |
| 560679 | N/A | N/A | GGACATACCATTAAAATACT | 7 | 4403 | 4422 | 1472 |
| 560680 | N/A | N/A | AAAGATGGGACATACCATTA | 0 | 4410 | 4429 | 1473 |
| 560681 | N/A | N/A | AGACCTGTGTGAAAGATGGG | 19 | 4421 | 4440 | 1474 |
| 560682 | N/A | N/A | TTTACAGACCTGTGTGAAAG | 22 | 4426 | 4445 | 1475 |
| 560683 | N/A | N/A | GTGTTTTTACAGACCTGTGT | 47 | 4431 | 4450 | 1476 |
| 560684 | N/A | N/A | ATTCAGTGTTTTTACAGACC | 44 | 4436 | 4455 | 1477 |
| 560685 | N/A | N/A | TTAGGATTCAGTGTTTTTAC | 46 | 4441 | 4460 | 1478 |
| 560686 | N/A | N/A | ATAATTTTAGGATTCAGTGT | 15 | 4447 | 4466 | 1479 |
| 560687 | N/A | N/A | GCTTGTAAATAATTTTAGGA | 0 | 4455 | 4474 | 1480 |
| 560688 | N/A | N/A | GTTAAAGCTTGTAAATAATT | 0 | 4461 | 4480 | 1481 |
| 560689 | N/A | N/A | TGTTTTATATCTCTTGAAAA | 0 | 5571 | 5590 | 1482 |
| 560690 | N/A | N/A | TTGGTAATAATATTTGTTTT | 9 | 5585 | 5604 | 1483 |
| 560691 | N/A | N/A | GGAAATTGGTAATAATATTT | 0 | 5590 | 5609 | 1484 |
| 560692 | N/A | N/A | TTAGTGGAAATTGGTAATAA | 22 | 5595 | 5614 | 1485 |
| 560693 | N/A | N/A | TTTGTTTAGTGGAAATTGGT | 8 | 5600 | 5619 | 1486 |
| 560694 | N/A | N/A | TTATGTTTGTTTAGTGGAAA | 0 | 5605 | 5624 | 1487 |
| 560695 | N/A | N/A | TAACATTATGTTTGTTTAGT | 12 | 5610 | 5629 | 1488 |
| 560696 | N/A | N/A | ACTACTAACATTATGTTTGT | 4 | 5615 | 5634 | 1489 |
| 560697 | N/A | N/A | GCAGCACTACTAACATTATG | 38 | 5620 | 5639 | 1490 |
| 560698 | N/A | N/A | TTTTAGCAGCACTACTAACA | 15 | 5625 | 5644 | 1491 |
| 560699 | N/A | N/A | AAACCTTTTAGCAGCACTAC | 52 | 5630 | 5649 | 1492 |
| 560700 | N/A | N/A | GATAAAAAACCTTTTAGCAG | 0 | 5636 | 5655 | 1493 |
| 560701 | N/A | N/A | TAGTTGATAAAAAACCTTTT | 0 | 5641 | 5660 | 1494 |
| 560702 | N/A | N/A | CAAAAGTAGTTGATAAAAAA | 0 | 5647 | 5666 | 1495 |
| 560703 | N/A | N/A | ATGGAAACCAAAAGTAGTTG | 13 | 5655 | 5674 | 1496 |
| 560704 | N/A | N/A | AAAGTATGGAAACCAAAAGT | 20 | 5660 | 5679 | 1497 |
| 560705 | N/A | N/A | GAAGGAAAGTATGGAAACCA | 45 | 5665 | 5684 | 1498 |
| 560706 | N/A | N/A | CATAAGAAGGAAAGTATGGA | 10 | 5670 | 5689 | 1499 |
| 560707 | N/A | N/A | TAACATCATAAGAAGGAAAG | 0 | 5676 | 5695 | 1500 |
| 560708 | N/A | N/A | GAATAATAACATCATAAGAA | 0 | 5682 | 5701 | 1501 |
| 560709 | N/A | N/A | GAATTTAGAATAATAACATC | 1 | 5689 | 5708 | 1502 |
| 560710 | N/A | N/A | TATAATTGAAAAGAATTTAG | 8 | 5701 | 5720 | 1503 |
| 560711 | N/A | N/A | TAGTAAAAGATATAATTGAA | 0 | 5711 | 5730 | 1504 |
| 560712 | N/A | N/A | AATCATAGTAAAAGATATAA | 10 | 5716 | 5735 | 1505 |
| 560713 | N/A | N/A | CAGGTTCATTTAATCATAGT | 43 | 5727 | 5746 | 1506 |
| 560714 | N/A | N/A | CTATAGTAACATTTTGCTTT | 24 | 5753 | 5772 | 1507 |
| 560715 | N/A | N/A | GTATATTACTATAGTAACAT | 18 | 5761 | 5780 | 1508 |
| 560716 | N/A | N/A | ACAATGTATATTACTATAGT | 0 | 5766 | 5785 | 1509 |
| 560717 | N/A | N/A | TAGACACAATGTATATTACT | 46 | 5771 | 5790 | 1510 |
| 560718 | N/A | N/A | TATTTTAGACACAATGTAT | 29 | 5777 | 5796 | 1511 |
| 560719 | N/A | N/A | ACACATTTTTATTTTAGAC | 15 | 5786 | 5805 | 1512 |
| 560720 | N/A | N/A | TTGGTTTCTTCACACATTTT | 62 | 5797 | 5816 | 1513 |
| 560721 | N/A | N/A | TTCATTGTTTGGTTTCTTC | 55 | 5806 | 5825 | 1514 |
| 560722 | N/A | N/A | CAGAAATTCATTGTTTTGGT | 55 | 5812 | 5831 | 1515 |
| 560723 | N/A | N/A | TCCAACTCAGAAATTCATTG | 65 | 5819 | 5838 | 48 |
| 560724 | N/A | N/A | CTTCTTCCAACTCAGAAATT | 41 | 5824 | 5843 | 1516 |
| 560725 | N/A | N/A | TGATCTAACTCTTCTTCCAA | 24 | 5834 | 5853 | 1517 |
| 560726 | N/A | N/A | TTAAATGATCTAACTCTTCT | 23 | 5839 | 5858 | 1518 |
| 560727 | N/A | N/A | TGAGAAAGTTAAATGATCTA | 0 | 5847 | 5866 | 1519 |
| 560728 | N/A | N/A | TACTTAAATTTTTAGAGTTT | 10 | 5886 | 5905 | 1520 |
| 560729 | N/A | N/A | AAAGTTACTTAAATTTTTAG | 3 | 5891 | 5910 | 1521 |
| 560730 | N/A | N/A | ATCTTAAAGTTACTTAAATT | 0 | 5896 | 5915 | 1522 |
| 560731 | N/A | N/A | ATGTGATCTTAAAGTTACTT | 24 | 5901 | 5920 | 1523 |
| 560732 | N/A | N/A | TAACTATGTGATCTTAAAGT | 0 | 5906 | 5925 | 1524 |
| 560733 | N/A | N/A | TTACTCTTTTCTACTAAGTA | 39 | 5924 | 5943 | 1525 |
| 560734 | N/A | N/A | GGGTATTACTCTTTTCTACT | 48 | 5929 | 5948 | 1526 |
| 560735 | N/A | N/A | TTGCTGGGTATTACTCTTTT | 75 | 5934 | 5953 | 49 |
| 560736 | N/A | N/A | TTTGCTTGCTGGGTATTACT | 65 | 5939 | 5958 | 50 |
| 560737 | N/A | N/A | TAAAGTTTGCTTGCTGGGTA | 49 | 5944 | 5963 | 1527 |

TABLE 133-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560738 | N/A | N/A | TATTGTAAAGTTTGCTTGCT | 15 | 5949 | 5968 | 1528 |
| 560739 | N/A | N/A | TAAAAGGATCTATTGTAAAG | 0 | 5959 | 5978 | 1529 |
| 560740 | N/A | N/A | TTATTTAAAAGGATCTATTG | 9 | 5964 | 5983 | 1530 |
| 560741 | N/A | N/A | GGACCTTATTTAAAAGGATC | 17 | 5969 | 5988 | 1531 |
| 560742 | N/A | N/A | GATATTTCCTAGGACCTTAT | 27 | 5980 | 5999 | 1532 |
| 560743 | N/A | N/A | TGAATGATATTTCCTAGGAC | 0 | 5985 | 6004 | 1533 |
| 560744 | N/A | N/A | TGGCATGAATGATATTTCCT | 74 | 5990 | 6009 | 51 |
| 560745 | N/A | N/A | GATGCTGGCATGAATGATAT | 40 | 5995 | 6014 | 1534 |
| 560746 | N/A | N/A | TTTTTTGATGCTGGCATGAA | 38 | 6001 | 6020 | 1535 |
| 560747 | N/A | N/A | GTTAGTTTTTTGATGCTGGC | 35 | 6006 | 6025 | 1536 |
| 560748 | N/A | N/A | TTAGTGTTAGTTTTTGATG | 0 | 6011 | 6030 | 1537 |
| 560749 | N/A | N/A | GCATTATTAGTGTTAGTTTT | 50 | 6017 | 6036 | 1538 |
| 560750 | N/A | N/A | ATCTTGCATTATTAGTGTTA | 49 | 6022 | 6041 | 1539 |
| 560751 | N/A | N/A | ATAATATCTTGCATTATTAG | 17 | 6027 | 6046 | 1540 |
| 560752 | N/A | N/A | CAGTAAGAAAAGCAGAATAT | 15 | 6047 | 6066 | 1541 |
| 560753 | N/A | N/A | TCATTGACAGTAAGAAAAGC | 47 | 6054 | 6073 | 1542 |
| 560754 | N/A | N/A | GATAGTTTTCTCATTGACA | 40 | 6065 | 6084 | 1543 |
| 560755 | N/A | N/A | GTTTGCAATTTATTGAATGA | 12 | 6083 | 6102 | 1544 |
| 560756 | N/A | N/A | GTGTTGGGTTTGCAATTTAT | 55 | 6090 | 6109 | 1545 |
| 560757 | N/A | N/A | TTAAGTGTGTTGGGTTTGCA | 50 | 6096 | 6115 | 1546 |
| 560758 | N/A | N/A | TTTTATTTAAGTGTGTTGGG | 5 | 6102 | 6121 | 1547 |
| 560759 | N/A | N/A | TTTAGCAGTAACATTTTATT | 19 | 6121 | 6140 | 1548 |
| 560760 | N/A | N/A | GTTAGTTTAGCAGTAACATT | 30 | 6126 | 6145 | 1549 |
| 560761 | N/A | N/A | TCTATATATTCAGTAGTTTA | 17 | 6148 | 6167 | 1550 |
| 560762 | N/A | N/A | TTACTTTCTATATATTCAGT | 14 | 6154 | 6173 | 1551 |
| 560763 | N/A | N/A | GTTTGCTTACTTTCTATATA | 20 | 6160 | 6179 | 1552 |
| 560764 | N/A | N/A | AGTTTGTTTGCTTACTTTCT | 36 | 6165 | 6184 | 1553 |
| 560765 | N/A | N/A | TGGCAAGTTTGTTTGCTTAC | 43 | 6170 | 6189 | 1554 |
| 560766 | N/A | N/A | TTACTGTTACTGTATTTCCC | 39 | 10155 | 10174 | 1555 |
| 560767 | N/A | N/A | ATGTAGTTACTGTTACTGTA | 18 | 10161 | 10180 | 1556 |
| 560768 | N/A | N/A | ATTTAATGGGTACAGACTCG | 47 | 10182 | 10201 | 61 |
| 560769 | N/A | N/A | ATGCAATTTAATGGGTACAG | 32 | 10187 | 10206 | 1557 |
| 560770 | N/A | N/A | TAGATATGCAATTTAATGGG | 4 | 10192 | 10211 | 1558 |
| 560771 | N/A | N/A | AGGAGATAGATATGCAATTT | 5 | 10198 | 10217 | 1559 |
| 560772 | N/A | N/A | CCTAAAGGAGATAGATATGC | 36 | 10203 | 10222 | 1560 |
| 560773 | N/A | N/A | AGCCTCCTAAAGGAGATAGA | 0 | 10208 | 10227 | 1561 |
| 560774 | N/A | N/A | CACCACCAGCCTCCTAAAGG | 35 | 10215 | 10234 | 1562 |
| 560775 | N/A | N/A | ATCTAAGAAAATTAATAAAC | 17 | 7003 | 7022 | 1563 |
| 560776 | N/A | N/A | ATGATCACATCTAAGAAAAT | 8 | 7011 | 7030 | 1564 |
| 560777 | N/A | N/A | ATACCATGATCACATCTAAG | 49 | 7016 | 7035 | 62 |
| 560778 | N/A | N/A | GCAATACCATGATCACATCT | 59 | 7019 | 7038 | 52 |
| 560779 | N/A | N/A | AACTGCAATACCATGATCAC | 35 | 7023 | 7042 | 1565 |
| 560780 | N/A | N/A | TAAAACTGCAATACCATGAT | 43 | 7026 | 7045 | 1566 |
| 560781 | N/A | N/A | CTTTAAAACTGCAATACCAT | 13 | 7029 | 7048 | 1567 |
| 560782 | N/A | N/A | TCTCCTTTAAAACTGCAATA | 18 | 7033 | 7052 | 1568 |
| 560783 | N/A | N/A | TGTTCTCCTTTAAAACTGCA | 13 | 7036 | 7055 | 1569 |
| 560784 | N/A | N/A | GATTGTTCTCCTTTAAAACT | 23 | 7039 | 7058 | 1570 |
| 560785 | N/A | N/A | AGGAGATTGTTCTCCTTTAA | 14 | 7043 | 7062 | 1571 |
| 560786 | N/A | N/A | AACAGGAGATTGTTCTCCTT | 0 | 7046 | 7065 | 1572 |
| 560787 | N/A | N/A | TTAAACAGGAGATTGTTCTC | 7 | 7049 | 7068 | 1573 |
| 560788 | N/A | N/A | CTCTTAAACAGGAGATTGTT | 10 | 7052 | 7071 | 1574 |
| 560789 | N/A | N/A | ACTCCGTAAATATTTCAGCA | 55 | 7077 | 7096 | 53 |
| 560790 | N/A | N/A | CTTTAACTCCGTAAATATTT | 22 | 7082 | 7101 | 1575 |
| 560791 | N/A | N/A | GACCTTTAACTCCGTAAATA | 54 | 7085 | 7104 | 63 |
| 560792 | N/A | N/A | AGTGACCTTTAACTCCGTAA | 35 | 7088 | 7107 | 1576 |
| 560793 | N/A | N/A | GGAGTCCAGTGACCTTTAAC | 15 | 7095 | 7114 | 1577 |
| 560794 | N/A | N/A | TCTGGAGTCCAGTGACCTTT | 46 | 7098 | 7117 | 64 |
| 560795 | N/A | N/A | ACCAGTCTGGAGTCCAGTGA | 8 | 7103 | 7122 | 1578 |
| 560796 | N/A | N/A | TCATCTTACCAAACTATTT | 22 | 7169 | 7188 | 1579 |
| 560797 | N/A | N/A | GAATCATCTTACCAAACTAT | 39 | 7172 | 7191 | 1580 |
| 560798 | N/A | N/A | TAAGAATCATCTTACCAAAC | 35 | 7175 | 7194 | 1581 |
| 560799 | N/A | N/A | ATGTAAGAATCATCTTACCA | 52 | 7178 | 7197 | 65 |
| 560800 | N/A | N/A | AAGAATGTAAGAATCATCTT | 22 | 7182 | 7201 | 1582 |
| 560801 | N/A | N/A | GTTATTAAGAATGTAAGAA | 0 | 7189 | 7208 | 1583 |
| 560802 | N/A | N/A | CGTGTTATTTAAGAATGTAA | 3 | 7192 | 7211 | 1584 |
| 560803 | N/A | N/A | AGCATTTTCTTAGATGGCG | 48 | 7210 | 7229 | 66 |
| 560804 | N/A | N/A | TAAAGCATTTTCTTAGATG | 0 | 7213 | 7232 | 1585 |
| 560805 | N/A | N/A | TGTTAAAGCATTTTCTTAG | 0 | 7216 | 7235 | 1586 |
| 560806 | N/A | N/A | TTTATGTTAAAGCATTTTC | 20 | 7220 | 7239 | 1587 |
| 560807 | N/A | N/A | ATGTTTATGTTAAAGCATTT | 8 | 7223 | 7242 | 1588 |
| 560808 | N/A | N/A | GCATTTTTCAGTAATGTTT | 40 | 7237 | 7256 | 1589 |
| 560809 | N/A | N/A | TGTAGCATTTTTCAGTAAT | 24 | 7241 | 7260 | 1590 |

TABLE 133-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560810 | N/A | N/A | CAAATGTAGCATTTTTTCAG | 0 | 7245 | 7264 | 1591 |
| 560811 | N/A | N/A | TGGCAAATGTAGCATTTTT | 60 | 7248 | 7267 | 54 |
| 560812 | N/A | N/A | AAGTTGTGGCAAATGTAGCA | 26 | 7254 | 7273 | 1592 |
| 560813 | N/A | N/A | ATGAAGTTGTGGCAAATGTA | 11 | 7257 | 7276 | 1593 |
| 560814 | N/A | N/A | TTTATGAAGTTGTGGCAAAT | 36 | 7260 | 7279 | 1594 |
| 560815 | N/A | N/A | CATTTTATGAAGTTGTGGCA | 45 | 7263 | 7282 | 67 |
| 560816 | N/A | N/A | TGACATTTTATGAAGTTGTG | 16 | 7266 | 7285 | 1595 |
| 560817 | N/A | N/A | CACTTGACATTTTATGAAGT | 47 | 7270 | 7289 | 68 |
| 560818 | N/A | N/A | CTTGAGATTTCACTTGACAT | 18 | 7280 | 7299 | 1596 |
| 560819 | N/A | N/A | TTTGGAGCTTGAGATTTCAC | 0 | 7287 | 7306 | 1597 |
| 560820 | N/A | N/A | ATCTTTGGAGCTTGAGATTT | 0 | 7290 | 7309 | 1598 |
| 560821 | N/A | N/A | AATATCTTTGGAGCTTGAGA | 6 | 7293 | 7312 | 1599 |
| 560822 | N/A | N/A | AATAATATCTTTGGAGCTTG | 24 | 7296 | 7315 | 1600 |
| 560823 | N/A | N/A | AGGAATAATATCTTTGGAGC | 1 | 7299 | 7318 | 1601 |
| 560824 | N/A | N/A | AATAGGAATAATATCTTTGG | 0 | 7302 | 7321 | 1602 |
| 560825 | N/A | N/A | AGTAATAGGAATAATATCTT | 0 | 7305 | 7324 | 1603 |
| 560826 | N/A | N/A | TTACATCAGATTTAGTAATA | 0 | 7318 | 7337 | 1604 |
| 560827 | N/A | N/A | AAATGTTATTACATCAGATT | 0 | 7326 | 7345 | 1605 |
| 560828 | N/A | N/A | ATAAAATGTTATTACATCAG | 12 | 7329 | 7348 | 1606 |
| 560829 | N/A | N/A | CCTAGAATCAATAAAATGTT | 13 | 7339 | 7358 | 1607 |
| 560830 | N/A | N/A | AGGAATGCCTAGAATCAATA | 9 | 7346 | 7365 | 1608 |
| 560831 | N/A | N/A | ATTCAGCAGGAATGCCTAGA | 26 | 7353 | 7372 | 1609 |
| 560832 | N/A | N/A | TACATTCAGCAGGAATGCCT | 23 | 7356 | 7375 | 1610 |
| 560833 | N/A | N/A | TTACCTGATATAACATCACA | 30 | 7456 | 7475 | 1611 |
| 560834 | N/A | N/A | GTTTTACCTGATATAACATC | 6 | 7459 | 7478 | 1612 |
| 560835 | N/A | N/A | CAGGTTTTACCTGATATAAC | 4 | 7462 | 7481 | 1613 |
| 560836 | N/A | N/A | TTAGACAGGTTTTACCTGAT | 6 | 7467 | 7486 | 1614 |
| 560837 | N/A | N/A | ATTCTCCTTAGACAGGTTTT | 6 | 7474 | 7493 | 1615 |
| 560838 | N/A | N/A | ACTGTCTATTCTCCTTAGAC | 0 | 7481 | 7500 | 1616 |
| 560839 | N/A | N/A | ACTACTGTCTATTCTCCTTA | 17 | 7484 | 7503 | 1617 |
| 560840 | N/A | N/A | ACTAACTACTGTCTATTCTC | 0 | 7488 | 7507 | 1618 |
| 560841 | N/A | N/A | TGAACTAACTACTGTCTATT | 0 | 7491 | 7510 | 1619 |
| 560842 | N/A | N/A | AGTTGAACTAACTACTGTCT | 0 | 7494 | 7513 | 1620 |
| 560844 | N/A | N/A | ATTAATTGATATGTAAAACG | 0 | 8347 | 8366 | 1621 |
| 560845 | N/A | N/A | CCAATTAATTGATATGTAAA | 15 | 8350 | 8369 | 1622 |
| 560846 | N/A | N/A | TCCTTTTAACTTCCAATTAA | 29 | 8362 | 8381 | 1623 |
| 560847 | N/A | N/A | TCCTGGTCCTTTTAACTTCC | 58 | 8368 | 8387 | 69 |
| 560848 | N/A | N/A | GTTTCCTGGTCCTTTTAACT | 0 | 8371 | 8390 | 1624 |
| 560849 | N/A | N/A | TCTGAGTTTCCTGGTCCTTT | 36 | 8376 | 8395 | 1625 |
| 560850 | N/A | N/A | ATGTCTGAGTTTCCTGGTCC | 31 | 8379 | 8398 | 1626 |
| 560851 | N/A | N/A | TGTATGTCTGAGTTTCCTGG | 0 | 8382 | 8401 | 1627 |
| 560852 | N/A | N/A | ATGTATACTGTATGTCTGAG | 19 | 8390 | 8409 | 1628 |
| 560853 | N/A | N/A | AAAATGTATACTGTATGTCT | 12 | 8393 | 8412 | 1629 |
| 560854 | N/A | N/A | TTTTAAAATGTATACTGTAT | 0 | 8397 | 8416 | 1630 |
| 560855 | N/A | N/A | CATACATTCTATATATTATA | 29 | 8432 | 8451 | 1631 |
| 560856 | N/A | N/A | AAGCCATACATTCTATATAT | 38 | 8436 | 8455 | 55 |
| 560857 | N/A | N/A | ATTATAAGCCATACATTCTA | 6 | 8441 | 8460 | 1632 |
| 560858 | N/A | N/A | TTCATTATAAGCCATACATT | 0 | 8444 | 8463 | 1633 |
| 560859 | N/A | N/A | TAATTCATTATAAGCCATAC | 19 | 8447 | 8466 | 1634 |
| 560860 | N/A | N/A | TGAGTTAACTAATTCATTAT | 0 | 8456 | 8475 | 1635 |
| 560861 | N/A | N/A | TTTGCATTGAGTTAACTAAT | 26 | 8463 | 8482 | 1636 |
| 560862 | N/A | N/A | TAATTTGCATTGAGTTAACT | 0 | 8466 | 8485 | 1637 |
| 560863 | N/A | N/A | GAATAATTTGCATTGAGTTA | 0 | 8469 | 8488 | 1638 |
| 560864 | N/A | N/A | ATAGAATAATTTGCATTGAG | 0 | 8472 | 8491 | 1639 |
| 560865 | N/A | N/A | AAAATAGAATAATTTGCATT | 0 | 8475 | 8494 | 1640 |
| 560866 | N/A | N/A | TTGTAATCAAAATAGAATAA | 0 | 8483 | 8502 | 1641 |
| 560867 | N/A | N/A | TATTTGTAATCAAAATAGAA | 16 | 8486 | 8505 | 1642 |
| 560868 | N/A | N/A | TACTATTTGTAATCAAAATA | 0 | 8489 | 8508 | 1643 |
| 560869 | N/A | N/A | TTTTACTATTTGTAATCAAA | 0 | 8492 | 8511 | 1644 |
| 560870 | N/A | N/A | GCTTATTTTACTATTTGTAA | 0 | 8497 | 8516 | 1645 |
| 560871 | N/A | N/A | CTTGCTTATTTTACTATTTG | 0 | 8500 | 8519 | 1646 |
| 560872 | N/A | N/A | TTATCTTGCTTATTTTACTA | 1 | 8504 | 8523 | 1647 |
| 560873 | N/A | N/A | GTTATTTTATCTTGCTTATT | 0 | 8510 | 8529 | 1648 |
| 560874 | N/A | N/A | AAACATCTGTTATTTTATCT | 0 | 8518 | 8537 | 1649 |
| 560875 | N/A | N/A | GGATTTTAAACATCTGTTAT | 0 | 8525 | 8544 | 1650 |
| 560876 | N/A | N/A | CTTTTTGGATTTTAAACATC | 24 | 8531 | 8550 | 1651 |
| 560877 | N/A | N/A | GTGCTTTTTGGATTTTAAAC | 6 | 8534 | 8553 | 1652 |
| 560878 | N/A | N/A | TTTTGTATGTGCTTTTTGGA | 24 | 8542 | 8561 | 1653 |
| 560879 | N/A | N/A | GACATCATTCATGGATTTTT | 50 | 8558 | 8577 | 70 |
| 560880 | N/A | N/A | AGTACTTAGACATCATTCAT | 43 | 8566 | 8585 | 71 |
| 560881 | N/A | N/A | TAAGTGAGTACTTAGACATC | 17 | 8572 | 8591 | 1654 |
| 560882 | N/A | N/A | TACTTTATAAGTGAGTACTT | 0 | 8579 | 8598 | 1655 |

TABLE 133-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560883 | N/A | N/A | TTCTACTTTATAAGTGAGTA | 32 | 8582 | 8601 | 1656 |
| 560884 | N/A | N/A | AATGTCTTCTACTTTATAAG | 0 | 8588 | 8607 | 1657 |
| 560885 | N/A | N/A | AATAATGAATGTCTTCTACT | 9 | 8595 | 8614 | 1658 |
| 560886 | N/A | N/A | TATAATAATGAATGTCTTCT | 0 | 8598 | 8617 | 1659 |
| 560887 | N/A | N/A | TGATATAATAATGAATGTCT | 29 | 8601 | 8620 | 1660 |
| 560888 | N/A | N/A | AAAATTTGATATAATAATGA | 0 | 8607 | 8626 | 1661 |
| 560889 | N/A | N/A | CATTTAAAAATTTGATATAA | 0 | 8613 | 8632 | 1662 |
| 560890 | N/A | N/A | GTACTGAGCATTTAAAAATT | 8 | 8621 | 8640 | 1663 |
| 560891 | N/A | N/A | GGTCAAATAGTACTGAGCAT | 40 | 8630 | 8649 | 72 |
| 560892 | N/A | N/A | AATGGTCAAATAGTACTGAG | 23 | 8633 | 8652 | 1664 |
| 560893 | N/A | N/A | TTAAATGGTCAAATAGTACT | 17 | 8636 | 8655 | 1665 |
| 560894 | N/A | N/A | AGTTTGAATACAAAATTTTT | 0 | 8654 | 8673 | 1666 |
| 560895 | N/A | N/A | GGTAGTTTGAATACAAAATT | 38 | 8657 | 8676 | 73 |
| 560896 | N/A | N/A | ACTGGTAGTTTGAATACAAA | 0 | 8660 | 8679 | 1667 |
| 560897 | N/A | N/A | TTCACTGGTAGTTTGAATAC | 0 | 8663 | 8682 | 1668 |
| 560898 | N/A | N/A | GCTTTCACTGGTAGTTTGAA | 25 | 8666 | 8685 | 1669 |
| 560899 | N/A | N/A | AGGGCTTTCACTGGTAGTTT | 30 | 8669 | 8688 | 1670 |
| 560900 | N/A | N/A | GGTAGGGCTTTCACTGGTAG | 9 | 8672 | 8691 | 1671 |
| 560901 | N/A | N/A | CTAGGTAGGGCTTTCACTGG | 37 | 8675 | 8694 | 1672 |
| 560902 | N/A | N/A | CTTCTAGGTAGGGCTTTCAC | 32 | 8678 | 8697 | 1673 |
| 560903 | N/A | N/A | TACCTTCTAGGTAGGGCTTT | 26 | 8681 | 8700 | 1674 |
| 560904 | N/A | N/A | GTATACCTTCTAGGTAGGGC | 0 | 8684 | 8703 | 1675 |
| 560905 | N/A | N/A | TGAGTATACCTTCTAGGTAG | 15 | 8687 | 8706 | 1676 |
| 560906 | N/A | N/A | CACTGAGTATACCTTCTAGG | 36 | 8690 | 8709 | 1677 |
| 560907 | N/A | N/A | TATCACTGAGTATACCTTCT | 0 | 8693 | 8712 | 1678 |
| 560908 | N/A | N/A | ACTTATCACTGAGTATACCT | 28 | 8696 | 8715 | 1679 |
| 560909 | N/A | N/A | ACAAAACTTATCACTGAGTA | 32 | 8701 | 8720 | 1680 |
| 560910 | N/A | N/A | GCTACAAAACTTATCACTGA | 15 | 8704 | 8723 | 1681 |
| 560911 | N/A | N/A | GGAGCTACAAAACTTATCAC | 21 | 8707 | 8726 | 1682 |
| 560912 | N/A | N/A | GATTTGGAGCTACAAAACTT | 0 | 8712 | 8731 | 1683 |
| 560913 | N/A | N/A | GAAGATTTGGAGCTACAAAA | 0 | 8715 | 8734 | 1684 |
| 560914 | N/A | N/A | CTATTAGAAGATTTGGAGCT | 0 | 8721 | 8740 | 1685 |
| 560915 | N/A | N/A | CACTCACTATTAGAAGATTT | 33 | 8727 | 8746 | 1686 |
| 560916 | N/A | N/A | TGTCAGCCTTTTATTTTGGG | 0 | 8751 | 8770 | 1687 |
| 560917 | N/A | N/A | ACCTGTCAGCCTTTTATTTT | 11 | 8754 | 8773 | 1688 |
| 560918 | N/A | N/A | TCGACTTACCTGTCAGCCTT | 0 | 8761 | 8780 | 1689 |
| 560919 | N/A | N/A | TTCTCGACTTACCTGTCAGC | 0 | 8764 | 8783 | 1690 |
| 560920 | N/A | N/A | GTATTCTCGACTTACCTGTC | 0 | 8767 | 8786 | 1691 |
| 560921 | N/A | N/A | TAACATCCATATACAGTCAA | 25 | 9177 | 9196 | 1692 |
| 560922 | N/A | N/A | TATTAACATCCATATACAGT | 20 | 9180 | 9199 | 1693 |
| 560923 | N/A | N/A | ATTTATTAACATCCATATAC | 20 | 9183 | 9202 | 1694 |
| 560924 | N/A | N/A | GCTATTTATTAACATCCATA | 47 | 9186 | 9205 | 1695 |
| 560925 | N/A | N/A | TCAGCTATTTATTAACATCC | 58 | 9189 | 9208 | 56 |
| 560926 | N/A | N/A | CTGTCAGCTATTTATTAACA | 30 | 9192 | 9211 | 1696 |
| 560927 | N/A | N/A | TTACTGTCAGCTATTTATTA | 22 | 9195 | 9214 | 1697 |
| 560928 | N/A | N/A | ACTTTACTGTCAGCTATTTA | 27 | 9198 | 9217 | 1698 |
| 560929 | N/A | N/A | TAAACTTTACTGTCAGCTAT | 41 | 9201 | 9220 | 1699 |
| 560930 | N/A | N/A | GGATAAACTTTACTGTCAGC | 45 | 9204 | 9223 | 1700 |
| 560931 | N/A | N/A | TATGGATAAACTTTACTGTC | 15 | 9207 | 9226 | 1701 |
| 560932 | N/A | N/A | TTATATGGATAAACTTTACT | 0 | 9210 | 9229 | 1702 |
| 560933 | N/A | N/A | TTGCAAGTCTTTATATGGAT | 47 | 9220 | 9239 | 1703 |
| 560934 | N/A | N/A | TATTTGCAAGTCTTTATATG | 26 | 9223 | 9242 | 1704 |
| 560935 | N/A | N/A | GAATATTTGCAAGTCTTTAT | 4 | 9226 | 9245 | 1705 |
| 560936 | N/A | N/A | GAGGAATATTTGCAAGTCTT | 58 | 9229 | 9248 | 57 |
| 560937 | N/A | N/A | GTAGAGGAATATTTGCAAGT | 47 | 9232 | 9251 | 1706 |
| 560938 | N/A | N/A | TTGGTAGAGGAATATTTGCA | 65 | 9235 | 9254 | 58 |
| 560939 | N/A | N/A | GTTACATTATTATAGATATT | 33 | 9269 | 9288 | 1707 |
| 560940 | N/A | N/A | TGTGTTACATTATTATAGAT | 20 | 9272 | 9291 | 1708 |
| 560941 | N/A | N/A | GAAATGTGTTACATTATTAT | 0 | 9276 | 9295 | 1709 |
| 560942 | N/A | N/A | ACCAGTGAAATGTGTTACAT | 56 | 9282 | 9301 | 59 |
| 560943 | N/A | N/A | TTCACCAGTGAAATGTGTTA | 19 | 9285 | 9304 | 1710 |
| 560944 | N/A | N/A | TGTTTCACCAGTGAAATGTG | 41 | 9288 | 9307 | 1711 |
| 560945 | N/A | N/A | ACATGTTTCACCAGTGAAAT | 0 | 9291 | 9310 | 1712 |
| 560946 | N/A | N/A | AAGACATGTTTCACCAGTGA | 48 | 9294 | 9313 | 1713 |
| 560947 | N/A | N/A | GACAAGACATGTTTCACCAG | 28 | 9297 | 9316 | 1714 |
| 560948 | N/A | N/A | TATGACAAGACATGTTTCAC | 13 | 9300 | 9319 | 1715 |
| 560949 | N/A | N/A | GCATATGACAAGACATGTTT | 12 | 9303 | 9322 | 1716 |
| 560950 | N/A | N/A | TAATGCATATGACAAGACAT | 4 | 9307 | 9326 | 1717 |
| 560951 | N/A | N/A | CTATAATGCATATGACAAGA | 22 | 9310 | 9329 | 1718 |
| 560952 | N/A | N/A | TTTCTATAATGCATATGACA | 23 | 9313 | 9332 | 1719 |
| 560953 | N/A | N/A | TCCTTTCTATAATGCATATG | 16 | 9316 | 9335 | 1720 |
| 560954 | N/A | N/A | TCTGATTATCCTTTCTATAA | 32 | 9324 | 9343 | 1721 |

TABLE 133-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 560955 | N/A | N/A | AAGTCTGATTATCCTTTCTA | 42 | 9327 | 9346 | 1722 |
| 560956 | N/A | N/A | TGAAAGTCTGATTATCCTTT | 51 | 9330 | 9349 | 60 |
| 560957 | N/A | N/A | AACTGAAAGTCTGATTATCC | 31 | 9333 | 9352 | 1723 |
| 560958 | N/A | N/A | TATAACTGAAAGTCTGATTA | 6 | 9336 | 9355 | 1724 |
| 560959 | N/A | N/A | GTTAAAAATATTAATATAAC | 3 | 9350 | 9369 | 1725 |
| 560960 | N/A | N/A | TGTGCACAAAAATGTTAAAA | 0 | 9363 | 9382 | 1726 |
| 560961 | N/A | N/A | CTATGTGCACAAAAATGTTA | 9 | 9366 | 9385 | 1727 |
| 560962 | N/A | N/A | TAGCTATGTGCACAAAAATG | 29 | 9369 | 9388 | 1728 |
| 560963 | N/A | N/A | AGATAGCTATGTGCACAAAA | 41 | 9372 | 9391 | 1729 |
| 560964 | N/A | N/A | TGAAGATAGCTATGTGCACA | 23 | 9375 | 9394 | 1730 |
| 560965 | N/A | N/A | TATTGAAGATAGCTATGTGC | 13 | 9378 | 9397 | 1731 |
| 560966 | N/A | N/A | TTTTATTGAAGATAGCTATG | 4 | 9381 | 9400 | 1732 |
| 560967 | N/A | N/A | CAATTTTATTGAAGATAGCT | 17 | 9384 | 9403 | 1733 |
| 560968 | N/A | N/A | AAACAATTTTATTGAAGATA | 27 | 9387 | 9406 | 1734 |
| 560969 | N/A | N/A | GTGTATCTTAAAATAATACC | 7 | 9412 | 9431 | 1735 |
| 560970 | N/A | N/A | TTAGTGTATCTTAAAATAAT | 25 | 9415 | 9434 | 1736 |
| 560971 | N/A | N/A | TGATCATTTTAGTGTATCTT | 34 | 9423 | 9442 | 1737 |
| 560972 | N/A | N/A | CCCTTGATCATTTTAGTGTA | 7 | 9427 | 9446 | 1738 |
| 560973 | N/A | N/A | AATCCCTTGATCATTTTAGT | 0 | 9430 | 9449 | 1739 |
| 560974 | N/A | N/A | TTGAATCCCTTGATCATTTT | 20 | 9433 | 9452 | 1740 |
| 560975 | N/A | N/A | TTAGTCTTGAATCCCTTGAT | 28 | 9439 | 9458 | 1741 |
| 560976 | N/A | N/A | TTGTTTAGTCTTGAATCCCT | 40 | 9443 | 9462 | 1742 |
| 560977 | N/A | N/A | GAGTTGTTTAGTCTTGAATC | 6 | 9446 | 9465 | 1743 |
| 560978 | N/A | N/A | ATTGAGTTGTTTAGTCTTGA | 14 | 9449 | 9468 | 1744 |
| 560979 | N/A | N/A | CTAATTGAGTTGTTTAGTCT | 0 | 9452 | 9471 | 1745 |
| 560980 | N/A | N/A | CAACTAATTGAGTTGTTTAG | 0 | 9455 | 9474 | 1746 |
| 560981 | N/A | N/A | ATTGGTGCAACTAATTGAGT | 0 | 9462 | 9481 | 1747 |
| 560982 | N/A | N/A | TTTATTGGTGCAACTAATTG | 9 | 9465 | 9484 | 1748 |
| 560983 | N/A | N/A | TTTTTTATTGGTGCAACTAA | 8 | 9468 | 9487 | 1749 |
| 560984 | N/A | N/A | TAAGTGTTTTTATTGGTGC | 20 | 9474 | 9493 | 1750 |
| 560985 | N/A | N/A | ACTGACAGTTTTTTAAGTG | 16 | 9488 | 9507 | 1751 |
| 560986 | N/A | N/A | GACACTGACAGTTTTTTAA | 6 | 9491 | 9510 | 1752 |
| 560987 | N/A | N/A | TTGGACACTGACAGTTTTTT | 0 | 9494 | 9513 | 1753 |
| 560988 | N/A | N/A | AGGTTGGACACTGACAGTTT | 6 | 9497 | 9516 | 1754 |
| 560989 | N/A | N/A | TACAGGTTGGACACTGACAG | 0 | 9500 | 9519 | 1755 |
| 544120 | 707 | 726 | AGTTCTTGGTGCTCTTGGCT | 72 | 6720 | 6739 | 15 |
| 337487 | 804 | 823 | CACTTGTATGTTCACCTCTG | 80 | 7389 | 7408 | 28 |
| 544145 | 1055 | 1074 | GTTGTCTTTCCAGTCTTCCA | 69 | 9630 | 9649 | 16 |
| 544156 | 1195 | 1214 | GCTTTGTGATCCCAAGTAGA | 61 | 9770 | 9789 | 17 |
| 544162 | 1269 | 1288 | GGTTGTTTTCTCCACACTCA | 71 | 10241 | 10260 | 18 |
| 544166 | 1353 | 1372 | ACCTTCCATTTTGAGACTTC | 65 | 10325 | 10344 | 19 |
| 544199 | 1907 | 1926 | TACACATACTCTGTGCTGAC | 69 | 10879 | 10898 | 20 |

TABLE 134

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563720 | N/A | N/A | TATATTGGATAATTTGAAAT | 7 | 11610 | 11629 | 1756 |
| 563721 | N/A | N/A | ATGTATATTGGATAATTTGA | 17 | 11613 | 11632 | 1757 |
| 563722 | N/A | N/A | GACATGTATATTGGATAATT | 20 | 11616 | 11635 | 1758 |
| 563723 | N/A | N/A | ATGACATGTATATTGGATAA | 29 | 11618 | 11637 | 1759 |
| 563724 | N/A | N/A | TATATATGACATGTATATTG | 9 | 11623 | 11642 | 1760 |
| 563725 | N/A | N/A | ATGTGACATATAAAAATATA | 4 | 11639 | 11658 | 1761 |
| 563726 | N/A | N/A | ATATGTGACATATAAAAATA | 0 | 11641 | 11660 | 1762 |
| 563727 | N/A | N/A | TTTATATATGTGACATATAA | 0 | 11646 | 11665 | 1763 |
| 563728 | N/A | N/A | CTTTTATATATGTGACATAT | 16 | 11648 | 11667 | 1764 |
| 563729 | N/A | N/A | ATCTTTTATATATGTGACAT | 13 | 11650 | 11669 | 1765 |
| 563730 | N/A | N/A | CATATCTTTTATATATGTGA | 2 | 11653 | 11672 | 1766 |
| 563731 | N/A | N/A | TCATACATATCTTTTATATA | 2 | 11658 | 11677 | 1767 |
| 563732 | N/A | N/A | TAGATCATACATATCTTTTA | 31 | 11662 | 11681 | 1768 |
| 563733 | N/A | N/A | CATAGATCATACATATCTTT | 28 | 11664 | 11683 | 1769 |
| 563734 | N/A | N/A | CACATAGATCATACATATCT | 56 | 11666 | 11685 | 1770 |
| 563735 | N/A | N/A | AGGATTCACATAGATCATAC | 56 | 11672 | 11691 | 1771 |

TABLE 134-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563736 | N/A | N/A | TTAGGATTCACATAGATCAT | 24 | 11674 | 11693 | 1772 |
| 563737 | N/A | N/A | ACTTAGGATTCACATAGATC | 49 | 11676 | 11695 | 1773 |
| 563738 | N/A | N/A | TTACTTAGGATTCACATAGA | 15 | 11678 | 11697 | 1774 |
| 563739 | N/A | N/A | TATTTACTTAGGATTCACAT | 6 | 11681 | 11700 | 1775 |
| 563740 | N/A | N/A | AATATTTACTTAGGATTCAC | 28 | 11683 | 11702 | 1776 |
| 563741 | N/A | N/A | TGTACTTTTCTGGAACAAAA | 63 | 11701 | 11720 | 1777 |
| 563742 | N/A | N/A | GATTATTTTTACCTTTATTA | 21 | 11724 | 11743 | 1778 |
| 563743 | N/A | N/A | TAGATTATTTTTACCTTTAT | 5 | 11726 | 11745 | 1779 |
| 563744 | N/A | N/A | ATTATAGATTATTTTTACCT | 12 | 11730 | 11749 | 1780 |
| 563745 | N/A | N/A | GAAAATTATAGATTATTTTT | 15 | 11734 | 11753 | 1781 |
| 563746 | N/A | N/A | GGTCCTGAAAATTATAGATT | 7 | 11740 | 11759 | 1782 |
| 563747 | N/A | N/A | GTGGTCCTGAAAATTATAGA | 29 | 11742 | 11761 | 1783 |
| 563748 | N/A | N/A | CTGTGGTCCTGAAAATTATA | 37 | 11744 | 11763 | 1784 |
| 563749 | N/A | N/A | GTCTGTGGTCCTGAAAATTA | 47 | 11746 | 11765 | 1785 |
| 563750 | N/A | N/A | TCGACAGCTTAGTCTGTGGT | 66 | 11757 | 11776 | 1786 |
| 563751 | N/A | N/A | TTTCGACAGCTTAGTCTGTG | 41 | 11759 | 11778 | 1787 |
| 563752 | N/A | N/A | AATTTCGACAGCTTAGTCTG | 40 | 11761 | 11780 | 1788 |
| 563753 | N/A | N/A | TTAATTTCGACAGCTTAGTC | 35 | 11763 | 11782 | 1789 |
| 563754 | N/A | N/A | CGTTAATTTCGACAGCTTAG | 50 | 11765 | 11784 | 1790 |
| 563755 | N/A | N/A | TGGCCCTAAAAAAATCAGCG | 7 | 11783 | 11802 | 1791 |
| 563756 | N/A | N/A | TCTGGCCCTAAAAAAATCAG | 0 | 11785 | 11804 | 1792 |
| 563757 | N/A | N/A | TGGTATTCTGGCCCTAAAAA | 37 | 11791 | 11810 | 1793 |
| 563758 | N/A | N/A | TTTGGTATTCTGGCCCTAAA | 29 | 11793 | 11812 | 1794 |
| 563759 | N/A | N/A | CCATTTTGGTATTCTGGCCC | 35 | 11797 | 11816 | 1795 |
| 563760 | N/A | N/A | GAGGAGCCATTTTGGTATTC | 34 | 11803 | 11822 | 1796 |
| 563761 | N/A | N/A | GAGAGGAGCCATTTTGGTAT | 18 | 11805 | 11824 | 1797 |
| 563762 | N/A | N/A | AAGAGAGGAGCCATTTTGGT | 17 | 11807 | 11826 | 1798 |
| 563763 | N/A | N/A | TGAAATTGTCCAATTTTGGG | 28 | 11829 | 11848 | 1799 |
| 563764 | N/A | N/A | TTTGAAATTGTCCAATTTTG | 10 | 11831 | 11850 | 1800 |
| 563765 | N/A | N/A | CATTTGAAATTGTCCAATTT | 22 | 11833 | 11852 | 1801 |
| 563766 | N/A | N/A | TGCATTTGAAATTGTCCAAT | 45 | 11835 | 11854 | 1802 |
| 563767 | N/A | N/A | ATTTTGCATTTGAAATTGTC | 35 | 11839 | 11858 | 1803 |
| 563768 | N/A | N/A | ATAATGAATTATTTTGCATT | 0 | 11849 | 11868 | 1804 |
| 563769 | N/A | N/A | TAAATAATGAATTATTTTGC | 17 | 11852 | 11871 | 1805 |
| 563770 | N/A | N/A | CTCATATATTAAATAATGAA | 0 | 11861 | 11880 | 1806 |
| 563771 | N/A | N/A | AACTCATATATTAAATAATG | 16 | 11863 | 11882 | 1807 |
| 563772 | N/A | N/A | TAGAGGAAGCAACTCATATA | 7 | 11873 | 11892 | 1808 |
| 563773 | N/A | N/A | AATAGAGGAAGCAACTCATA | 20 | 11875 | 11894 | 1809 |
| 563774 | N/A | N/A | CAAATAGAGGAAGCAACTCA | 29 | 11877 | 11896 | 1810 |
| 563775 | N/A | N/A | ACCAAATAGAGGAAGCAACT | 27 | 11879 | 11898 | 1811 |
| 563776 | N/A | N/A | AAACCAAATAGAGGAAGCAA | 22 | 11881 | 11900 | 1812 |
| 563777 | N/A | N/A | GGAAACCAAATAGAGGAAGC | 37 | 11883 | 11902 | 1813 |
| 563778 | N/A | N/A | TAAGGAAACCAAATAGAGGA | 0 | 11886 | 11905 | 1814 |
| 563779 | N/A | N/A | TTTAAGGAAACCAAATAGAG | 0 | 11888 | 11907 | 1815 |
| 563780 | N/A | N/A | TGTTTTCTTCTGGAAGCAGA | 5 | 3100 | 3119 | 1816 |
| 563781 | N/A | N/A | CTTACTTTAAGTGAAGTTAC | 0 | 3636 | 3655 | 1817 |
| 563782 | N/A | N/A | TTTTCTACTTACTTTAAGTG | 3 | 3643 | 3662 | 1818 |
| 563783 | N/A | N/A | ACATGAACCCTCTTTATTTT | 0 | 3659 | 3678 | 1819 |
| 563784 | N/A | N/A | GAAAACATAAACATGAACCC | 0 | 3669 | 3688 | 1820 |
| 563785 | N/A | N/A | AGATCCACATTGAAAACATA | 8 | 3680 | 3699 | 1821 |
| 563786 | N/A | N/A | TTAAAAGATCCACATTGAAA | 8 | 3685 | 3704 | 1822 |
| 563787 | N/A | N/A | GCCTTAGAAATATTTTTTTT | 2 | 3703 | 3722 | 1823 |
| 563788 | N/A | N/A | CAAATGGCATGCCTTAGAAA | 29 | 3713 | 3732 | 1824 |
| 563789 | N/A | N/A | TATTTCAAATGGCATGCCTT | 24 | 3718 | 3737 | 1825 |
| 563790 | N/A | N/A | CAAAGTATTTCAAATGGCAT | 8 | 3723 | 3742 | 1826 |
| 563791 | N/A | N/A | TGCAACAAAGTATTTCAAAT | 0 | 3728 | 3747 | 1827 |
| 563792 | N/A | N/A | TCAACAATGCAACAAAGTAT | 3 | 3735 | 3754 | 1828 |
| 563793 | N/A | N/A | GAAAAAAAAGTATTTCAACA | 4 | 3749 | 3768 | 1829 |
| 563794 | N/A | N/A | GATTATTTTCTTGGAAAAA | 11 | 3763 | 3782 | 1830 |
| 563795 | N/A | N/A | GAAATTTTATTTTCTGGAGA | 10 | 3781 | 3800 | 1831 |
| 563796 | N/A | N/A | AAAATTATAATAGGAAATTTT | 14 | 3793 | 3812 | 1832 |
| 563797 | N/A | N/A | CTGAATATAATGAATGAAAT | 1 | 7854 | 7873 | 1833 |
| 563798 | N/A | N/A | TACCTGAATATAATGAATGA | 4 | 7857 | 7876 | 1834 |
| 563799 | N/A | N/A | GACTACCTGAATATAATGAA | 25 | 7860 | 7879 | 1835 |
| 563800 | N/A | N/A | ATGGACTACCTGAATATAAT | 15 | 7863 | 7882 | 1836 |
| 563801 | N/A | N/A | TCCATGGACTACCTGAATAT | 39 | 7866 | 7885 | 1837 |
| 563802 | N/A | N/A | ACCATCAAGCCTCCCAAAAC | 23 | 7952 | 7971 | 1838 |
| 563803 | N/A | N/A | CCTTACCATCAAGCCTCCCA | 29 | 7956 | 7975 | 1839 |
| 563804 | N/A | N/A | AGTCCCCTTACCATCAAGCC | 31 | 7961 | 7980 | 1840 |
| 563805 | N/A | N/A | TGTAGTCCCCTTACCATCAA | 18 | 7964 | 7983 | 1841 |
| 563806 | N/A | N/A | GAATGTAGTCCCCTTACCAT | 0 | 7967 | 7986 | 1842 |
| 563807 | N/A | N/A | ATTGAATGTAGTCCCCTTAC | 12 | 7970 | 7989 | 1843 |

TABLE 134-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563808 | N/A | N/A | ATGATTGAATGTAGTCCCCT | 14 | 7973 | 7992 | 1844 |
| 563809 | N/A | N/A | GATTAGCAAGTGAATGAATG | 13 | 7990 | 8009 | 1845 |
| 563810 | N/A | N/A | GTAGATTAGCAAGTGAATGA | 25 | 7993 | 8012 | 1846 |
| 563811 | N/A | N/A | TTTGTAGATTAGCAAGTGAA | 9 | 7996 | 8015 | 1847 |
| 563812 | N/A | N/A | ATATTTGTAGATTAGCAAGT | 0 | 7999 | 8018 | 1848 |
| 563813 | N/A | N/A | CCATAAGAGGTTCTCAGTAA | 44 | 8019 | 8038 | 1849 |
| 563814 | N/A | N/A | GGTCCATAAGAGGTTCTCAG | 37 | 8022 | 8041 | 1850 |
| 563815 | N/A | N/A | CCTGGTCCATAAGAGGTTCT | 25 | 8025 | 8044 | 1851 |
| 563816 | N/A | N/A | TAATACCTGGTCCATAAGAG | 9 | 8030 | 8049 | 1852 |
| 563817 | N/A | N/A | TCCTAATACCTGGTCCATAA | 39 | 8033 | 8052 | 1853 |
| 563818 | N/A | N/A | TTTTCCTAATACCTGGTCCA | 43 | 8036 | 8055 | 1854 |
| 563819 | N/A | N/A | TACTTTTCCTAATACCTGGT | 43 | 8039 | 8058 | 1855 |
| 563820 | N/A | N/A | CGTTACTACTTTTCCTAATA | 47 | 8045 | 8064 | 1856 |
| 563821 | N/A | N/A | AAGGCTGAGACTGCTTCTCG | 46 | 8067 | 8086 | 1857 |
| 563822 | N/A | N/A | GATAATAAATTATATGAAGG | 5 | 8083 | 8102 | 1858 |
| 563823 | N/A | N/A | GTTTGATAATAAATTATATG | 0 | 8087 | 8106 | 1859 |
| 563824 | N/A | N/A | GTGTAATTGTTTGATAATAA | 14 | 8095 | 8114 | 1860 |
| 563825 | N/A | N/A | AATGTGTAATTGTTTGATAA | 0 | 8098 | 8117 | 1861 |
| 563826 | N/A | N/A | GTAATTTACTAACAAATGTG | 18 | 8112 | 8131 | 1862 |
| 563827 | N/A | N/A | AGTGTAATTTACTAACAAAT | 0 | 8115 | 8134 | 1863 |
| 563828 | N/A | N/A | ATAAGTGTAATTTACTAACA | 0 | 8118 | 8137 | 1864 |
| 563829 | N/A | N/A | GTAATAAGTGTAATTTACTA | 0 | 8121 | 8140 | 1865 |
| 563830 | N/A | N/A | GTTGTAATAAGTGTAATTTA | 20 | 8124 | 8143 | 1866 |
| 563831 | N/A | N/A | ACAGTTGTAATAAGTGTAAT | 1 | 8127 | 8146 | 1867 |
| 563832 | N/A | N/A | ATAACAGTTGTAATAAGTGT | 4 | 8130 | 8149 | 1868 |
| 563833 | N/A | N/A | TTCAAATAATAACAGTTGTA | 0 | 8138 | 8157 | 1869 |
| 563834 | N/A | N/A | ATAATTCAAATAATAACAGT | 16 | 8142 | 8161 | 1870 |
| 563835 | N/A | N/A | AATTGTGATAAATATAATTC | 0 | 8155 | 8174 | 1871 |
| 563836 | N/A | N/A | ATGTAATTGTGATAAATATA | 0 | 8159 | 8178 | 1872 |
| 563837 | N/A | N/A | GACATGTAATTGTGATAAAT | 8 | 8162 | 8181 | 1873 |
| 563838 | N/A | N/A | ACAGACATGTAATTGTGATA | 33 | 8165 | 8184 | 1874 |
| 563839 | N/A | N/A | AGAACAGACATGTAATTGTG | 34 | 8168 | 8187 | 1875 |
| 563840 | N/A | N/A | TTAAGAACAGACATGTAATT | 0 | 8171 | 8190 | 1876 |
| 563841 | N/A | N/A | AAGTATATTTAAGAACAGAC | 0 | 8179 | 8198 | 1877 |
| 563842 | N/A | N/A | TTAAATTGTGATAAGTATAT | 1 | 8191 | 8210 | 1878 |
| 563843 | N/A | N/A | GAATTAAATTGTGATAAGTA | 0 | 8194 | 8213 | 1879 |
| 563844 | N/A | N/A | GTGGAATTAAATTGTGATAA | 0 | 8197 | 8216 | 1880 |
| 563845 | N/A | N/A | GCCGTGGAATTAAATTGTGA | 20 | 8200 | 8219 | 1881 |
| 563846 | N/A | N/A | TAAGCCGTGGAATTAAATTG | 16 | 8203 | 8222 | 1882 |
| 563847 | N/A | N/A | TTGTAAGCCGTGGAATTAAA | 28 | 8206 | 8225 | 1883 |
| 563848 | N/A | N/A | TCATTGTAAGCCGTGGAATT | 25 | 8209 | 8228 | 1884 |
| 563849 | N/A | N/A | TGATCATTGTAAGCCGTGGA | 49 | 8212 | 8231 | 1885 |
| 563850 | N/A | N/A | TATAGTTATGATCATTGTAA | 0 | 8220 | 8239 | 1886 |
| 563851 | N/A | N/A | AATTATAGTTATGATCATTG | 0 | 8223 | 8242 | 1887 |
| 563852 | N/A | N/A | CTTTAATAATTATAGTTATG | 0 | 8230 | 8249 | 1888 |
| 563853 | N/A | N/A | TGTCTTTAATAATTATAGTT | 4 | 8233 | 8252 | 1889 |
| 563854 | N/A | N/A | AATTGTCTTTAATAATTATA | 0 | 8236 | 8255 | 1890 |
| 563855 | N/A | N/A | TCAAAATTGTCTTTAATAAT | 7 | 8240 | 8259 | 1891 |
| 563856 | N/A | N/A | ATTTAATCAAAATTGTCTTT | 0 | 8246 | 8265 | 1892 |
| 563857 | N/A | N/A | TAACATTTAATCAAAATTGT | 0 | 8250 | 8269 | 1893 |
| 563858 | N/A | N/A | ACATAACATTTAATCAAAAT | 0 | 8253 | 8272 | 1894 |
| 563859 | N/A | N/A | ATGACATAACATTTAATCAA | 13 | 8256 | 8275 | 1895 |
| 563860 | N/A | N/A | TACTTATGACATAACATTTA | 0 | 8261 | 8280 | 1896 |
| 563861 | N/A | N/A | TTACTACTTATGACATAACA | 0 | 8265 | 8284 | 1897 |
| 563862 | N/A | N/A | AACAGTTACTACTTATGACA | 31 | 8270 | 8289 | 1898 |
| 563863 | N/A | N/A | TGTAACAGTTACTACTTATG | 29 | 8273 | 8292 | 1899 |
| 563864 | N/A | N/A | CTTATTTGTAACAGTTACTA | 0 | 8279 | 8298 | 1900 |
| 563865 | N/A | N/A | TTTCACAGCTTATTTGTAAC | 29 | 8287 | 8306 | 1901 |
| 563866 | N/A | N/A | TCTTTTCACAGCTTATTTGT | 22 | 8290 | 8309 | 1902 |
| 563867 | N/A | N/A | GGTTCTTTTCACAGCTTATT | 66 | 8293 | 8312 | 1903 |
| 563868 | N/A | N/A | CTAGGAGTGGTTCTTTTCAC | 37 | 8301 | 8320 | 1904 |
| 563869 | N/A | N/A | ATGCTAGGAGTGGTTCTTTT | 20 | 8304 | 8323 | 1905 |
| 563870 | N/A | N/A | CTAATGCTAGGAGTGGTTCT | 30 | 8307 | 8326 | 1906 |
| 563871 | N/A | N/A | AGAGTGACTAATGCTAGGAG | 41 | 8314 | 8333 | 1907 |
| 563872 | N/A | N/A | AGAGAATAGAGTGACTAATG | 28 | 8321 | 8340 | 1908 |
| 563873 | N/A | N/A | TTAATGAGAGAATAGAGTGA | 4 | 8327 | 8346 | 1909 |
| 563496 | 608 | 627 | CTGTTGGTTTAATTGTTTAT | 33 | 4346 | 4365 | 1910 |
| 563497 | 610 | 629 | TGCTGTTGGTTTAATTGTTT | 29 | 4348 | 4367 | 1911 |
| 563498 | 612 | 631 | TATGCTGTTGGTTTAATTGT | 27 | 4350 | 4369 | 1912 |
| 563499 | 614 | 633 | ACTATGCTGTTGGTTTAATT | 24 | 4352 | 4371 | 1913 |
| 563500 | 616 | 635 | TGACTATGCTGTTGGTTTAA | 68 | 4354 | 4373 | 1914 |
| 563501 | 619 | 638 | ATTTGACTATGCTGTTGGTT | 45 | 4357 | 4376 | 1915 |

TABLE 134-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563502 | 621 | 640 | TTATTTGACTATGCTGTTGG | 39 | 4359 | 4378 | 1916 |
| 563503 | 623 | 642 | TTTTATTTGACTATGCTGTT | 33 | 4361 | 4380 | 1917 |
| 563504 | 625 | 644 | TCTTTTATTTGACTATGCTG | 55 | 4363 | 4382 | 1918 |
| 563505 | 627 | 646 | TTTCTTTTATTTGACTATGC | 29 | 4365 | 4384 | 1919 |
| 563506 | 646 | 665 | CTTCTGAGCTGATTTTCTAT | 40 | N/A | N/A | 1920 |
| 563507 | 648 | 667 | TCCTTCTGAGCTGATTTTCT | 76 | N/A | N/A | 1921 |
| 563508 | 650 | 669 | AGTCCTTCTGAGCTGATTTT | 37 | N/A | N/A | 1922 |
| 563509 | 652 | 671 | CTAGTCCTTCTGAGCTGATT | 52 | N/A | N/A | 1923 |
| 563510 | 654 | 673 | TACTAGTCCTTCTGAGCTGA | 52 | 6667 | 6686 | 1924 |
| 563511 | 656 | 675 | AATACTAGTCCTTCTGAGCT | 41 | 6669 | 6688 | 1925 |
| 563512 | 658 | 677 | TGAATACTAGTCCTTCTGAG | 55 | 6671 | 6690 | 1926 |
| 563513 | 660 | 679 | CTTGAATACTAGTCCTTCTG | 43 | 6673 | 6692 | 1927 |
| 563514 | 662 | 681 | TTCTTGAATACTAGTCCTTC | 34 | 6675 | 6694 | 1928 |
| 563515 | 666 | 685 | TGGGTTCTTGAATACTAGTC | 52 | 6679 | 6698 | 1929 |
| 563516 | 668 | 687 | TGTGGGTTCTTGAATACTAG | 34 | 6681 | 6700 | 1930 |
| 563517 | 670 | 689 | TCTGTGGGTTCTTGAATACT | 43 | 6683 | 6702 | 1931 |
| 563518 | 680 | 699 | TAGAGAAATTTCTGTGGGTT | 0 | 6693 | 6712 | 1932 |
| 563519 | 684 | 703 | AAGATAGAGAAATTTCTGTG | 4 | 6697 | 6716 | 1933 |
| 563520 | 686 | 705 | GGAAGATAGAGAAATTTCTG | 0 | 6699 | 6718 | 1934 |
| 563521 | 694 | 713 | CTTGGCTTGGAAGATAGAGA | 29 | 6707 | 6726 | 1935 |
| 563522 | 696 | 715 | CTCTTGGCTTGGAAGATAGA | 51 | 6709 | 6728 | 1936 |
| 563523 | 705 | 724 | TTCTTGGTGCTCTTGGCTTG | 63 | 6718 | 6737 | 75 |
| 544120 | 707 | 726 | AGTTCTTGGTGCTCTTGGCT | 86 | 6720 | 6739 | 15 |
| 563524 | 715 | 734 | AAGGGAGTAGTTCTTGGTGC | 44 | 6728 | 6747 | 1937 |
| 563525 | 716 | 735 | AAAGGGAGTAGTTCTTGGTG | 14 | 6729 | 6748 | 1938 |
| 563526 | 717 | 736 | GAAAGGGAGTAGTTCTTGGT | 33 | 6730 | 6749 | 1939 |
| 563527 | 718 | 737 | AGAAAGGGAGTAGTTCTTGG | 0 | 6731 | 6750 | 1940 |
| 563528 | 719 | 738 | AAGAAAGGGAGTAGTTCTTG | 0 | 6732 | 6751 | 1941 |
| 563529 | 720 | 739 | GAAGAAAGGGAGTAGTTCTT | 0 | 6733 | 6752 | 1942 |
| 563530 | 726 | 745 | TCAACTGAAGAAAGGGAGTA | 0 | 6739 | 6758 | 1943 |
| 337481 | 728 | 747 | ATTCAACTGAAGAAAGGGAG | 23 | 6741 | 6760 | 1944 |
| 563531 | 729 | 748 | CATTCAACTGAAGAAAGGGA | 16 | 6742 | 6761 | 1945 |
| 563532 | 730 | 749 | TCATTCAACTGAAGAAAGGG | 23 | 6743 | 6762 | 1946 |
| 563533 | 732 | 751 | TTTCATTCAACTGAAGAAAG | 8 | 6745 | 6764 | 1947 |
| 563534 | 733 | 752 | ATTTCATTCAACTGAAGAAA | 6 | 6746 | 6765 | 1948 |
| 563535 | 734 | 753 | TATTTCATTCAACTGAAGAA | 0 | 6747 | 6766 | 1949 |
| 563536 | 735 | 754 | TTATTTCATTCAACTGAAGA | 0 | 6748 | 6767 | 1950 |
| 563537 | 736 | 755 | CTTATTTCATTCAACTGAAG | 11 | 6749 | 6768 | 1951 |
| 337482 | 737 | 756 | TCTTATTTCATTCAACTGAA | 26 | 6750 | 6769 | 1952 |
| 563538 | 738 | 757 | TTCTTATTTCATTCAACTGA | 17 | 6751 | 6770 | 1953 |
| 563539 | 740 | 759 | ATTTCTTATTTCATTCAACT | 18 | 6753 | 6772 | 1954 |
| 563540 | 743 | 762 | TACATTTCTTATTTCATTCA | 20 | 6756 | 6775 | 1955 |
| 563541 | 767 | 786 | TTCAGCAGGAATGCCATCAT | 34 | N/A | N/A | 1956 |
| 563542 | 768 | 787 | ATTCAGCAGGAATGCCATCA | 2 | N/A | N/A | 1957 |
| 563543 | 769 | 788 | CATTCAGCAGGAATGCCATC | 21 | N/A | N/A | 1958 |
| 563544 | 770 | 789 | ACATTCAGCAGGAATGCCAT | 5 | N/A | N/A | 1959 |
| 563545 | 771 | 790 | TACATTCAGCAGGAATGCCA | 37 | N/A | N/A | 1960 |
| 563546 | 772 | 791 | GTACATTCAGCAGGAATGCC | 50 | 7357 | 7376 | 1961 |
| 563547 | 773 | 792 | GGTACATTCAGCAGGAATGC | 64 | 7358 | 7377 | 76 |
| 563548 | 774 | 793 | TGGTACATTCAGCAGGAATG | 42 | 7359 | 7378 | 1962 |
| 563549 | 775 | 794 | GTGGTACATTCAGCAGGAAT | 51 | 7360 | 7379 | 1963 |
| 563550 | 776 | 795 | GGTGGTACATTCAGCAGGAA | 24 | 7361 | 7380 | 1964 |
| 563551 | 777 | 796 | TGGTGGTACATTCAGCAGGA | 47 | 7362 | 7381 | 1965 |
| 563552 | 778 | 797 | ATGGTGGTACATTCAGCAGG | 0 | 7363 | 7382 | 1966 |
| 563553 | 779 | 798 | AATGGTGGTACATTCAGCAG | 15 | 7364 | 7383 | 1967 |
| 563554 | 780 | 799 | AAATGGTGGTACATTCAGCA | 32 | 7365 | 7384 | 1968 |
| 563555 | 781 | 800 | TAAATGGTGGTACATTCAGC | 29 | 7366 | 7385 | 1969 |
| 563556 | 783 | 802 | TATAAATGGTGGTACATTCA | 33 | 7368 | 7387 | 1970 |
| 563557 | 784 | 803 | TTATAAATGGTGGTACATTC | 1 | 7369 | 7388 | 1971 |
| 563558 | 785 | 804 | GTTATAAATGGTGGTACATT | 4 | 7370 | 7389 | 1972 |
| 563559 | 786 | 805 | TGTTATAAATGGTGGTACAT | 0 | 7371 | 7390 | 1973 |
| 563560 | 787 | 806 | CTGTTATAAATGGTGGTACA | 4 | 7372 | 7391 | 1974 |
| 563561 | 788 | 807 | TCTGTTATAAATGGTGGTAC | 29 | 7373 | 7392 | 1975 |
| 337484 | 789 | 808 | CTCTGTTATAAATGGTGGTA | 62 | 7374 | 7393 | 74 |
| 563562 | 792 | 811 | CACCTCTGTTATAAATGGTG | 22 | 7377 | 7396 | 1976 |
| 563563 | 793 | 812 | TCACCTCTGTTATAAATGGT | 38 | 7378 | 7397 | 1977 |
| 337485 | 794 | 813 | TTCACCTCTGTTATAAATGG | 18 | 7379 | 7398 | 1978 |
| 563564 | 795 | 814 | GTTCACCTCTGTTATAAATG | 52 | 7380 | 7399 | 1979 |
| 563565 | 797 | 816 | ATGTTCACCTCTGTTATAAA | 24 | 7382 | 7401 | 1980 |
| 563566 | 798 | 817 | TATGTTCACCTCTGTTATAA | 2 | 7383 | 7402 | 1981 |
| 337486 | 799 | 818 | GTATGTTCACCTCTGTTATA | 32 | 7384 | 7403 | 1982 |
| 563567 | 800 | 819 | TGTATGTTCACCTCTGTTAT | 38 | 7385 | 7404 | 1983 |

TABLE 134-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337487 | 804 | 823 | CACTTGTATGTTCACCTCTG | 87 | 7389 | 7408 | 28 |
| 563568 | 1128 | 1147 | TAATCGCAACTAGATGTAGC | 39 | 9703 | 9722 | 1984 |
| 563569 | 1129 | 1148 | GTAATCGCAACTAGATGTAG | 26 | 9704 | 9723 | 1985 |
| 563570 | 1130 | 1149 | AGTAATCGCAACTAGATGTA | 17 | 9705 | 9724 | 1986 |
| 563571 | 1131 | 1150 | CAGTAATCGCAACTAGATGT | 43 | 9706 | 9725 | 1987 |
| 563572 | 1132 | 1151 | CCAGTAATCGCAACTAGATG | 39 | 9707 | 9726 | 1988 |
| 563573 | 1133 | 1152 | GCCAGTAATCGCAACTAGAT | 59 | 9708 | 9727 | 1989 |
| 563574 | 1134 | 1153 | TGCCAGTAATCGCAACTAGA | 57 | 9709 | 9728 | 1990 |
| 563575 | 1135 | 1154 | TTGCCAGTAATCGCAACTAG | 54 | 9710 | 9729 | 1991 |
| 563576 | 1136 | 1155 | ATTGCCAGTAATCGCAACTA | 43 | 9711 | 9730 | 1992 |
| 563577 | 1137 | 1156 | CATTGCCAGTAATCGCAACT | 49 | 9712 | 9731 | 1993 |
| 563578 | 1138 | 1157 | ACATTGCCAGTAATCGCAAC | 59 | 9713 | 9732 | 1994 |
| 563579 | 1139 | 1158 | GACATTGCCAGTAATCGCAA | 64 | 9714 | 9733 | 1995 |
| 563580 | 1140 | 1159 | GGACATTGCCAGTAATCGCA | 79 | 9715 | 9734 | 77 |
| 563581 | 1141 | 1160 | GGGACATTGCCAGTAATCGC | 47 | 9716 | 9735 | 1996 |
| 563582 | 1162 | 1181 | TTGTTTTCCGGGATTGCATT | 20 | 9737 | 9756 | 1997 |
| 563583 | 1163 | 1182 | TTTGTTTTCCGGGATTGCAT | 31 | 9738 | 9757 | 1998 |
| 563584 | 1167 | 1186 | AATCTTTGTTTTCCGGGATT | 14 | 9742 | 9761 | 1999 |
| 563585 | 1168 | 1187 | AAATCTTTGTTTTCCGGGAT | 54 | 9743 | 9762 | 2000 |
| 563586 | 1175 | 1194 | AAACACCAAATCTTTGTTTT | 32 | 9750 | 9769 | 2001 |
| 563587 | 1176 | 1195 | AAAACACCAAATCTTTGTTT | 7 | 9751 | 9770 | 2002 |
| 563588 | 1180 | 1199 | GTAGAAAACACCAAATCTTT | 18 | 9755 | 9774 | 2003 |
| 563589 | 1181 | 1200 | AGTAGAAAACACCAAATCTT | 0 | 9756 | 9775 | 2004 |
| 563590 | 1185 | 1204 | CCCAAGTAGAAAACACCAAA | 26 | 9760 | 9779 | 2005 |
| 563591 | 1186 | 1205 | TCCCAAGTAGAAAACACCAA | 27 | 9761 | 9780 | 2006 |
| 563592 | 1190 | 1209 | GTGATCCCAAGTAGAAAACA | 26 | 9765 | 9784 | 2007 |
| 563593 | 1191 | 1210 | TGTGATCCCAAGTAGAAAAC | 28 | 9766 | 9785 | 2008 |
| 563594 | 1192 | 1211 | TTGTGATCCCAAGTAGAAAA | 12 | 9767 | 9786 | 2009 |
| 563595 | 1193 | 1212 | TTTGTGATCCCAAGTAGAAA | 14 | 9768 | 9787 | 2010 |
| 563596 | 1200 | 1219 | CTTTTGCTTTGTGATCCCAA | 64 | 9775 | 9794 | 2011 |
| 563597 | 1204 | 1223 | TGTCCTTTTGCTTTGTGATC | 24 | 9779 | 9798 | 2012 |
| 563598 | 1205 | 1224 | GTGTCCTTTTGCTTTGTGAT | 31 | 9780 | 9799 | 2013 |
| 563599 | 1206 | 1225 | AGTGTCCTTTTGCTTTGTGA | 41 | 9781 | 9800 | 2014 |
| 563600 | 1210 | 1229 | TTGAAGTGTCCTTTTGCTTT | 21 | 9785 | 9804 | 2015 |
| 563601 | 1211 | 1230 | GTTGAAGTGTCCTTTTGCTT | 35 | 9786 | 9805 | 2016 |
| 563602 | 1212 | 1231 | AGTTGAAGTGTCCTTTTGCT | 27 | 9787 | 9806 | 2017 |
| 563603 | 1213 | 1232 | CAGTTGAAGTGTCCTTTTGC | 17 | 9788 | 9807 | 2018 |
| 563604 | 1214 | 1233 | ACAGTTGAAGTGTCCTTTTG | 0 | 9789 | 9808 | 2019 |
| 563605 | 1215 | 1234 | GACAGTTGAAGTGTCCTTTT | 19 | 9790 | 9809 | 2020 |
| 563606 | 1216 | 1235 | GGACAGTTGAAGTGTCCTTT | 34 | 9791 | 9810 | 2021 |
| 563607 | 1217 | 1236 | TGGACAGTTGAAGTGTCCTT | 12 | 9792 | 9811 | 2022 |
| 563608 | 1218 | 1237 | CTGGACAGTTGAAGTGTCCT | 39 | 9793 | 9812 | 2023 |
| 563609 | 1219 | 1238 | TCTGGACAGTTGAAGTGTCC | 10 | 9794 | 9813 | 2024 |
| 563610 | 1220 | 1239 | CTCTGGACAGTTGAAGTGTC | 6 | 9795 | 9814 | 2025 |
| 563611 | 1221 | 1240 | CCTCTGGACAGTTGAAGTGT | 24 | 9796 | 9815 | 2026 |
| 563612 | 1222 | 1241 | CCCTCTGGACAGTTGAAGTG | 24 | 9797 | 9816 | 2027 |
| 563613 | 1223 | 1242 | ACCCTCTGGACAGTTGAAGT | 31 | 9798 | 9817 | 2028 |
| 563614 | 1224 | 1243 | AACCCTCTGGACAGTTGAAG | 34 | 9799 | 9818 | 2029 |
| 563615 | 1225 | 1244 | TAACCCTCTGGACAGTTGAA | 34 | 9800 | 9819 | 2030 |
| 563616 | 1226 | 1245 | ATAACCCTCTGGACAGTTGA | 31 | 9801 | 9820 | 2031 |
| 563617 | 1227 | 1246 | AATAACCCTCTGGACAGTTG | 22 | 9802 | 9821 | 2032 |
| 563618 | 1228 | 1247 | GAATAACCCTCTGGACAGTT | 25 | 9803 | 9822 | 2033 |
| 563619 | 1229 | 1248 | TGAATAACCCTCTGGACAGT | 18 | 9804 | 9823 | 2034 |
| 563620 | 1230 | 1249 | CTGAATAACCCTCTGGACAG | 24 | 9805 | 9824 | 2035 |
| 563621 | 1231 | 1250 | CCTGAATAACCCTCTGGACA | 39 | 9806 | 9825 | 2036 |
| 563622 | 1232 | 1251 | TCCTGAATAACCCTCTGGAC | 31 | N/A | N/A | 2037 |
| 563623 | 1233 | 1252 | CTCCTGAATAACCCTCTGGA | 15 | N/A | N/A | 2038 |
| 563624 | 1234 | 1253 | CCTCCTGAATAACCCTCTGG | 27 | N/A | N/A | 2039 |
| 563625 | 1235 | 1254 | GCCTCCTGAATAACCCTCTG | 25 | N/A | N/A | 2040 |
| 563626 | 1236 | 1255 | AGCCTCCTGAATAACCCTCT | 32 | N/A | N/A | 2041 |
| 563627 | 1237 | 1256 | CAGCCTCCTGAATAACCCTC | 44 | N/A | N/A | 2042 |
| 563628 | 1238 | 1257 | CCAGCCTCCTGAATAACCCT | 26 | N/A | N/A | 2043 |
| 563629 | 1239 | 1258 | ACCAGCCTCCTGAATAACCC | 23 | N/A | N/A | 2044 |
| 337503 | 1240 | 1259 | CACCAGCCTCCTGAATAACC | 25 | N/A | N/A | 2045 |
| 563630 | 1241 | 1260 | CCACCAGCCTCCTGAATAAC | 26 | N/A | N/A | 2046 |
| 563631 | 1242 | 1261 | ACCACCAGCCTCCTGAATAA | 25 | N/A | N/A | 2047 |
| 563632 | 1243 | 1262 | CACCACCAGCCTCCTGAATA | 33 | N/A | N/A | 2048 |
| 563633 | 1244 | 1263 | CCACCACCAGCCTCCTGAAT | 45 | N/A | N/A | 2049 |
| 563634 | 1248 | 1267 | CATGCCACCACCAGCCTCCT | 54 | 10220 | 10239 | 2050 |
| 563635 | 1250 | 1269 | ATCATGCCACCACCAGCCTC | 58 | 10222 | 10241 | 2051 |
| 563636 | 1251 | 1270 | CATCATGCCACCACCAGCCT | 61 | 10223 | 10242 | 2052 |
| 563637 | 1255 | 1274 | CACTCATCATGCCACCACCA | 68 | 10227 | 10246 | 78 |

TABLE 134-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563638 | 1256 | 1275 | ACACTCATCATGCCACCACC | 65 | 10228 | 10247 | 2053 |
| 563639 | 1260 | 1279 | CTCCACACTCATCATGCCAC | 76 | 10232 | 10251 | 79 |
| 563640 | 1262 | 1281 | TTCTCCACACTCATCATGCC | 55 | 10234 | 10253 | 2054 |
| 563641 | 1263 | 1282 | TTTCTCCACACTCATCATGC | 63 | 10235 | 10254 | 80 |
| 563642 | 1264 | 1283 | TTTTCTCCACACTCATCATG | 24 | 10236 | 10255 | 2055 |
| 563643 | 1265 | 1284 | GTTTTCTCCACACTCATCAT | 53 | 10237 | 10256 | 2056 |
| 563644 | 1857 | 1876 | ATTTAAGAACTGTACAATTA | 7 | 10829 | 10848 | 2057 |
| 563645 | 1858 | 1877 | CATTTAAGAACTGTACAATT | 15 | 10830 | 10849 | 2058 |
| 563646 | 1859 | 1878 | ACATTTAAGAACTGTACAAT | 4 | 10831 | 10850 | 2059 |
| 563647 | 1860 | 1879 | AACATTTAAGAACTGTACAA | 4 | 10832 | 10851 | 2060 |
| 563648 | 1861 | 1880 | CAACATTTAAGAACTGTACA | 4 | 10833 | 10852 | 2061 |
| 563649 | 1862 | 1881 | ACAACATTTAAGAACTGTAC | 22 | 10834 | 10853 | 2062 |
| 563650 | 1863 | 1882 | TACAACATTTAAGAACTGTA | 21 | 10835 | 10854 | 2063 |
| 563651 | 1864 | 1883 | CTACAACATTTAAGAACTGT | 44 | 10836 | 10855 | 2064 |
| 563652 | 1865 | 1884 | ACTACAACATTTAAGAACTG | 20 | 10837 | 10856 | 2065 |
| 563653 | 1866 | 1885 | TACTACAACATTTAAGAACT | 15 | 10838 | 10857 | 2066 |
| 563654 | 1867 | 1886 | ATACTACAACATTTAAGAAC | 17 | 10839 | 10858 | 2067 |
| 563655 | 1868 | 1887 | AATACTACAACATTTAAGAA | 11 | 10840 | 10859 | 2068 |
| 563656 | 1869 | 1888 | TAATACTACAACATTTAAGA | 9 | 10841 | 10860 | 2069 |
| 563657 | 1870 | 1889 | TTAATACTACAACATTTAAG | 3 | 10842 | 10861 | 2070 |
| 563658 | 1874 | 1893 | GAAATTAATACTACAACATT | 0 | 10846 | 10865 | 2071 |
| 563659 | 1878 | 1897 | TTTTGAAATTAATACTACAA | 0 | 10850 | 10869 | 2072 |
| 563660 | 1879 | 1898 | GTTTTGAAATTAATACTACA | 15 | 10851 | 10870 | 2073 |
| 563661 | 1880 | 1899 | AGTTTTGAAATTAATACTAC | 2 | 10852 | 10871 | 2074 |
| 563662 | 1881 | 1900 | TAGTTTTGAAATTAATACTA | 14 | 10853 | 10872 | 2075 |
| 563663 | 1882 | 1901 | TTAGTTTTGAAATTAATACT | 8 | 10854 | 10873 | 2076 |
| 563664 | 1888 | 1907 | CGATTTTTAGTTTTGAAATT | 0 | 10860 | 10879 | 2077 |
| 563665 | 1889 | 1908 | ACGATTTTTAGTTTTGAAAT | 0 | 10861 | 10880 | 2078 |
| 563666 | 1890 | 1909 | GACGATTTTTAGTTTTGAAA | 20 | 10862 | 10881 | 2079 |
| 563667 | 1891 | 1910 | TGACGATTTTTAGTTTTGAA | 17 | 10863 | 10882 | 2080 |
| 563668 | 1892 | 1911 | CTGACGATTTTTAGTTTTGA | 64 | 10864 | 10883 | 2081 |
| 563669 | 1893 | 1912 | GCTGACGATTTTTAGTTTTG | 66 | 10865 | 10884 | 81 |
| 563670 | 1894 | 1913 | TGCTGACGATTTTTAGTTTT | 45 | 10866 | 10885 | 2082 |
| 563671 | 1895 | 1914 | GTGCTGACGATTTTTAGTTT | 42 | 10867 | 10886 | 2083 |
| 563672 | 1896 | 1915 | TGTGCTGACGATTTTTAGTT | 50 | 10868 | 10887 | 2084 |
| 563673 | 1897 | 1916 | CTGTGCTGACGATTTTTAGT | 55 | 10869 | 10888 | 2085 |
| 563674 | 1898 | 1917 | TCTGTGCTGACGATTTTTAG | 53 | 10870 | 10889 | 2086 |
| 563675 | 1899 | 1918 | CTCTGTGCTGACGATTTTTA | 49 | 10871 | 10890 | 2087 |
| 563676 | 1900 | 1919 | ACTCTGTGCTGACGATTTTT | 22 | 10872 | 10891 | 2088 |
| 563677 | 1901 | 1920 | TACTCTGTGCTGACGATTTT | 8 | 10873 | 10892 | 2089 |
| 563678 | 1902 | 1921 | ATACTCTGTGCTGACGATTT | 61 | 10874 | 10893 | 2090 |
| 563679 | 1903 | 1922 | CATACTCTGTGCTGACGATT | 68 | 10875 | 10894 | 2091 |
| 563680 | 1904 | 1923 | ACATACTCTGTGCTGACGAT | 4 | 10876 | 10895 | 2092 |
| 563681 | 1905 | 1924 | CACATACTCTGTGCTGACGA | 73 | 10877 | 10896 | 82 |
| 563682 | 1909 | 1928 | TTTACACATACTCTGTGCTG | 67 | 10881 | 10900 | 83 |
| 563683 | 1911 | 1930 | TTTTTACACATACTCTGTGC | 58 | 10883 | 10902 | 2093 |
| 563684 | 1915 | 1934 | CAGATTTTTACACATACTCT | 54 | 10887 | 10906 | 2094 |
| 563685 | 1916 | 1935 | ACAGATTTTTACACATACTC | 52 | 10888 | 10907 | 2095 |
| 563686 | 1917 | 1936 | TACAGATTTTTACACATACT | 40 | 10889 | 10908 | 2096 |
| 563687 | 1918 | 1937 | TTACAGATTTTTACACATAC | 22 | 10890 | 10909 | 2097 |
| 337528 | 1920 | 1939 | TATTACAGATTTTTACACAT | 4 | 6720 | 6739 | 2098 |
| 563688 | 1922 | 1941 | TGTATTACAGATTTTTACAC | 0 | 10894 | 10913 | 2099 |
| 563689 | 1935 | 1954 | CAGTTTAAAAATTTGTATTA | 8 | 10907 | 10926 | 2100 |
| 563690 | 1938 | 1957 | CATCAGTTTAAAAATTTGTA | 18 | 10910 | 10929 | 2101 |
| 563691 | 1941 | 1960 | AAGCATCAGTTTAAAAATTT | 16 | 10913 | 10932 | 2102 |
| 563692 | 1942 | 1961 | GAAGCATCAGTTTAAAAATT | 16 | 10914 | 10933 | 2103 |
| 563693 | 1951 | 1970 | TAGCAAAATGAAGCATCAGT | 40 | 10923 | 10942 | 2104 |
| 563694 | 1952 | 1971 | GTAGCAAAATGAAGCATCAG | 42 | 10924 | 10943 | 2105 |
| 563695 | 1953 | 1972 | TGTAGCAAAATGAAGCATCA | 44 | 10925 | 10944 | 2106 |
| 563696 | 1954 | 1973 | TTGTAGCAAAATGAAGCATC | 48 | 10926 | 10945 | 2107 |
| 563697 | 1955 | 1974 | TTTGTAGCAAAATGAAGCAT | 19 | 10927 | 10946 | 2108 |
| 563698 | 1974 | 1993 | AACATTTACTCCAAATTATT | 27 | 10946 | 10965 | 2109 |
| 563699 | 1976 | 1995 | CAAACATTTACTCCAAATTA | 23 | 10948 | 10967 | 2110 |
| 563700 | 1978 | 1997 | ATCAAACATTTACTCCAAAT | 24 | 10950 | 10969 | 2111 |
| 563701 | 1981 | 2000 | CATATCAAACATTTACTCCA | 61 | 10953 | 10972 | 2112 |
| 563702 | 1982 | 2001 | TCATATCAAACATTTACTCC | 50 | 10954 | 10973 | 2113 |
| 563703 | 1983 | 2002 | ATCATATCAAACATTTACTC | 31 | 10955 | 10974 | 2114 |
| 563704 | 1990 | 2009 | TAAATAAATCATATCAAACA | 10 | 10962 | 10981 | 2115 |
| 563705 | 1993 | 2012 | TCATAAATAAATCATATCAA | 20 | 10965 | 10984 | 2116 |
| 563706 | 1994 | 2013 | TTCATAAATAAATCATATCA | 11 | 10966 | 10985 | 2117 |
| 563707 | 1995 | 2014 | TTTCATAAATAAATCATATC | 5 | 10967 | 10986 | 2118 |
| 563708 | 1996 | 2015 | GTTTCATAAATAAATCATAT | 0 | 10968 | 10987 | 2119 |

TABLE 134-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563709 | 1997 | 2016 | GGTTTCATAAATAAATCATA | 8 | 10969 | 10988 | 2120 |
| 563710 | 1998 | 2017 | AGGTTTCATAAATAAATCAT | 15 | 10970 | 10989 | 2121 |
| 563711 | 1999 | 2018 | TAGGTTTCATAAATAAATCA | 19 | 10971 | 10990 | 2122 |
| 563712 | 2001 | 2020 | ATTAGGTTTCATAAATAAAT | 12 | 10973 | 10992 | 2123 |
| 563713 | 2002 | 2021 | CATTAGGTTTCATAAATAAA | 2 | 10974 | 10993 | 2124 |
| 563714 | 2003 | 2022 | TCATTAGGTTTCATAAATAA | 7 | 10975 | 10994 | 2125 |
| 563715 | 2004 | 2023 | TTCATTAGGTTTCATAAATA | 11 | 10976 | 10995 | 2126 |
| 563716 | 2005 | 2024 | CTTCATTAGGTTTCATAAAT | 15 | 10977 | 10996 | 2127 |
| 563717 | 2006 | 2025 | GCTTCATTAGGTTTCATAAA | 49 | 10978 | 10997 | 2128 |
| 563718 | 2010 | 2029 | TTCTGCTTCATTAGGTTTCA | 57 | 10982 | 11001 | 2129 |
| 563719 | 2013 | 2032 | TAATTCTGCTTCATTAGGTT | 43 | 10985 | 11004 | 2130 |

TABLE 135

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 566915 | 343 | 362 | TATGTAGTTCTTCTCAGTTC | 22 | 3447 | 3466 | 2131 |
| 566916 | 350 | 369 | TAGTTTATATGTAGTTCTTC | 21 | 3454 | 3473 | 2132 |
| 566917 | 354 | 373 | CTTGTAGTTTATATGTAGTT | 12 | 3458 | 3477 | 2133 |
| 566918 | 358 | 377 | TTGACTTGTAGTTTATATGT | 12 | 3462 | 3481 | 2134 |
| 566919 | 360 | 379 | TTTTGACTTGTAGTTTATAT | 0 | 3464 | 3483 | 2135 |
| 566920 | 362 | 381 | ATTTTTGACTTGTAGTTTAT | 7 | 3466 | 3485 | 2136 |
| 566921 | 367 | 386 | TCTTCATTTTTGACTTGTAG | 33 | 3471 | 3490 | 2137 |
| 566922 | 371 | 390 | TACCTCTTCATTTTTGACTT | 22 | 3475 | 3494 | 2138 |
| 566923 | 377 | 396 | ATTCTTTACCTCTTCATTTT | 12 | 3481 | 3500 | 2139 |
| 566924 | 387 | 406 | CAAGTGACATATTCTTTACC | 36 | 3491 | 3510 | 2140 |
| 566925 | 389 | 408 | TTCAAGTGACATATTCTTTA | 31 | 3493 | 3512 | 2141 |
| 566926 | 394 | 413 | TTGAGTTCAAGTGACATATT | 18 | 3498 | 3517 | 2142 |
| 566927 | 396 | 415 | AGTTGAGTTCAAGTGACATA | 6 | 3500 | 3519 | 2143 |
| 566928 | 400 | 419 | TTTGAGTTGAGTTCAAGTGA | 11 | 3504 | 3523 | 2144 |
| 566929 | 408 | 427 | TTTCAAGTTTTGAGTTGAGT | 15 | 3512 | 3531 | 2145 |
| 566930 | 410 | 429 | GCTTTCAAGTTTTGAGTTGA | 13 | 3514 | 3533 | 2146 |
| 566931 | 412 | 431 | AGGCTTTCAAGTTTTGAGTT | 22 | 3516 | 3535 | 2147 |
| 566932 | 416 | 435 | TAGGAGGCTTTCAAGTTTTG | 4 | 3520 | 3539 | 2148 |
| 566933 | 419 | 438 | TTCTAGGAGGCTTTCAAGTT | 35 | 3523 | 3542 | 2149 |
| 566934 | 421 | 440 | TCTTCTAGGAGGCTTTCAAG | 26 | 3525 | 3544 | 2150 |
| 566935 | 429 | 448 | GAATTTTTTCTTCTAGGAGG | 1 | 3533 | 3552 | 2151 |
| 566936 | 434 | 453 | AAGTAGAATTTTTTCTTCTA | 0 | 3538 | 3557 | 2152 |
| 566937 | 436 | 455 | TGAAGTAGAATTTTTTCTTC | 11 | 3540 | 3559 | 2153 |
| 566938 | 438 | 457 | GTTGAAGTAGAATTTTTTCT | 29 | 3542 | 3561 | 2154 |
| 566939 | 441 | 460 | TTTGTTGAAGTAGAATTTTT | 11 | 3545 | 3564 | 2155 |
| 566940 | 443 | 462 | TTTTTGTTGAAGTAGAATTT | 35 | 3547 | 3566 | 2156 |
| 566941 | 464 | 483 | TTGCTCTTCTAAATATTTCA | 35 | 3568 | 3587 | 2157 |
| 566942 | 466 | 485 | AGTTGCTCTTCTAAATATTT | 53 | 3570 | 3589 | 2158 |
| 566943 | 468 | 487 | TTAGTTGCTCTTCTAAATAT | 18 | 3572 | 3591 | 2159 |
| 566944 | 471 | 490 | TAGTTAGTTGCTCTTCTAAA | 38 | 3575 | 3594 | 2160 |
| 566945 | 476 | 495 | TAAGTTAGTTAGTTGCTCTT | 28 | 3580 | 3599 | 2161 |
| 566946 | 478 | 497 | ATTAAGTTAGTTAGTTGCTC | 28 | 3582 | 3601 | 2162 |
| 566947 | 480 | 499 | GAATTAAGTTAGTTAGTTGC | 27 | 3584 | 3603 | 2163 |
| 566948 | 482 | 501 | TTGAATTAAGTTAGTTAGTT | 21 | 3586 | 3605 | 2164 |
| 566949 | 484 | 503 | TTTTGAATTAAGTTAGTTAG | 2 | 3588 | 3607 | 2165 |
| 566950 | 487 | 506 | TGATTTTGAATTAAGTTAGT | 9 | 3591 | 3610 | 2166 |
| 566951 | 490 | 509 | GGTTGATTTGAATTAAGTT | 52 | 3594 | 3613 | 2167 |
| 566952 | 497 | 516 | AGTTTCAGGTTGATTTTGAA | 13 | 3601 | 3620 | 2168 |
| 566953 | 501 | 520 | CTGGAGTTTCAGGTTGATTT | 50 | 3605 | 3624 | 2169 |
| 566954 | 507 | 526 | GGTGTTCTGGAGTTTCAGGT | 35 | 3611 | 3630 | 2170 |
| 566955 | 509 | 528 | TGGGTGTTCTGGAGTTTCAG | 18 | 3613 | 3632 | 2171 |
| 566956 | 511 | 530 | TCTGGGTGTTCTGGAGTTTC | 32 | 3615 | 3634 | 2172 |
| 566957 | 513 | 532 | CTTCTGGGTGTTCTGGAGTT | 28 | 3617 | 3636 | 2173 |
| 566958 | 515 | 534 | TACTTCTGGGTGTTCTGGAG | 23 | 3619 | 3638 | 2174 |
| 566959 | 517 | 536 | GTTACTTCTGGGTGTTCTGG | 12 | 3621 | 3640 | 2175 |
| 566960 | 519 | 538 | AAGTTACTTCTGGGTGTTCT | 1 | 3623 | 3642 | 2176 |
| 566961 | 522 | 541 | GTGAAGTTACTTCTGGGTGT | 0 | 3626 | 3645 | 2177 |

TABLE 135-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 566962 | 528 | 547 | TTTTAAGTGAAGTTACTTCT | 6 | N/A | N/A | 2178 |
| 566963 | 530 | 549 | AGTTTTAAGTGAAGTTACTT | 16 | N/A | N/A | 2179 |
| 566964 | 532 | 551 | AAAGTTTTAAGTGAAGTTAC | 12 | N/A | N/A | 2180 |
| 566965 | 535 | 554 | ACAAAAGTTTTAAGTGAAGT | 8 | N/A | N/A | 2181 |
| 337474 | 537 | 556 | CTACAAAAGTTTTAAGTGAA | 10 | N/A | N/A | 2182 |
| 566966 | 539 | 558 | TTCTACAAAAGTTTTAAGTG | 46 | N/A | N/A | 2183 |
| 566967 | 544 | 563 | TGTTTTTCTACAAAAGTTTT | 12 | N/A | N/A | 2184 |
| 566968 | 546 | 565 | CTTGTTTTTCTACAAAAGTT | 0 | N/A | N/A | 2185 |
| 566969 | 552 | 571 | TATTATCTTGTTTTTCTACA | 0 | 4290 | 4309 | 2186 |
| 566970 | 557 | 576 | GATGCTATTATCTTGTTTTT | 18 | 4295 | 4314 | 2187 |
| 566971 | 560 | 579 | TTTGATGCTATTATCTTGTT | 22 | 4298 | 4317 | 2188 |
| 566972 | 562 | 581 | TCTTTGATGCTATTATCTTG | 21 | 4300 | 4319 | 2189 |
| 566973 | 569 | 588 | GAGAAGGTCTTTGATGCTAT | 37 | 4307 | 4326 | 2190 |
| 566974 | 574 | 593 | GTCTGGAGAAGGTCTTTGAT | 26 | 4312 | 4331 | 2191 |
| 566975 | 576 | 595 | CGGTCTGGAGAAGGTCTTTG | 20 | 4314 | 4333 | 2192 |
| 566976 | 578 | 597 | CACGGTCTGGAGAAGGTCTT | 53 | 4316 | 4335 | 2193 |
| 566977 | 580 | 599 | TCCACGGTCTGGAGAAGGTC | 58 | 4318 | 4337 | 2194 |
| 566978 | 582 | 601 | CTTCCACGGTCTGGAGAAGG | 39 | 4320 | 4339 | 2195 |
| 566979 | 584 | 603 | GTCTTCCACGGTCTGGAGAA | 63 | 4322 | 4341 | 2196 |
| 566980 | 586 | 605 | TGGTCTTCCACGGTCTGGAG | 81 | 4324 | 4343 | 2197 |
| 566981 | 588 | 607 | ATTGGTCTTCCACGGTCTGG | 57 | 4326 | 4345 | 2198 |
| 566982 | 590 | 609 | ATATTGGTCTTCCACGGTCT | 60 | 4328 | 4347 | 2199 |
| 566983 | 592 | 611 | TTATATTGGTCTTCCACGGT | 49 | 4330 | 4349 | 2200 |
| 566984 | 594 | 613 | GTTTATATTGGTCTTCCACG | 54 | 4332 | 4351 | 2201 |
| 566985 | 596 | 615 | TTGTTTATATTGGTCTTCCA | 36 | 4334 | 4353 | 2202 |
| 566986 | 598 | 617 | AATTGTTTATATTGGTCTTC | 23 | 4336 | 4355 | 2203 |
| 566987 | 600 | 619 | TTAATTGTTTATATTGGTCT | 26 | 4338 | 4357 | 2204 |
| 566988 | 602 | 621 | GTTTAATTGTTTATATTGGT | 23 | 4340 | 4359 | 2205 |
| 566989 | 604 | 623 | TGGTTTAATTGTTTATATTG | 8 | 4342 | 4361 | 2206 |
| 566990 | 606 | 625 | GTTGGTTTAATTGTTTATAT | 1 | 4344 | 4363 | 2207 |
| 544120 | 707 | 726 | AGTTCTTGGTGCTCTTGGCT | 78 | 6720 | 6739 | 15 |
| 337487 | 804 | 823 | CACTTGTATGTTCACCTCTG | 82 | 7389 | 7408 | 28 |
| 566991 | 912 | 931 | TTTGTGATCCATCTATTCGA | 25 | 7899 | 7918 | 2208 |
| 566992 | 913 | 932 | TTTTGTGATCCATCTATTCG | 12 | 7900 | 7919 | 2209 |
| 566993 | 920 | 939 | ATTGAAGTTTTGTGATCCAT | 32 | 7907 | 7926 | 2210 |
| 566994 | 921 | 940 | CATTGAAGTTTTGTGATCCA | 26 | 7908 | 7927 | 2211 |
| 566995 | 922 | 941 | TCATTGAAGTTTTGTGATCC | 0 | 7909 | 7928 | 2212 |
| 566996 | 923 | 942 | TTCATTGAAGTTTTGTGATC | 1 | 7910 | 7929 | 2213 |
| 566997 | 924 | 943 | TTTCATTGAAGTTTTGTGAT | 20 | 7911 | 7930 | 2214 |
| 566998 | 944 | 963 | ATATTTGTAGTTCTCCCACG | 35 | 7931 | 7950 | 2215 |
| 566999 | 952 | 971 | CCAAAACCATATTTGTAGTT | 13 | 7939 | 7958 | 2216 |
| 567000 | 953 | 972 | CCCAAAACCATATTTGTAGT | 21 | 7940 | 7959 | 2217 |
| 567001 | 954 | 973 | TCCCAAAACCATATTTGTAG | 0 | 7941 | 7960 | 2218 |
| 567002 | 955 | 974 | CTCCCAAAACCATATTTGTA | 5 | 7942 | 7961 | 2219 |
| 567003 | 958 | 977 | AGCCTCCCAAAACCATATTT | 0 | 7945 | 7964 | 2220 |
| 567004 | 960 | 979 | CAAGCCTCCCAAAACCATAT | 14 | 7947 | 7966 | 2221 |
| 567005 | 961 | 980 | TCAAGCCTCCCAAAACCATA | 0 | 7948 | 7967 | 2222 |
| 567006 | 962 | 981 | ATCAAGCCTCCCAAAACCAT | 17 | 7949 | 7968 | 2223 |
| 567007 | 963 | 982 | CATCAAGCCTCCCAAAACCA | 31 | 7950 | 7969 | 2224 |
| 567008 | 964 | 983 | CCATCAAGCCTCCCAAAACC | 11 | 7951 | 7970 | 2225 |
| 567009 | 965 | 984 | TCCATCAAGCCTCCCAAAAC | 27 | N/A | N/A | 2226 |
| 567010 | 966 | 985 | CTCCATCAAGCCTCCCAAAA | 42 | N/A | N/A | 2227 |
| 567011 | 972 | 991 | AAAATTCTCCATCAAGCCTC | 48 | N/A | N/A | 2228 |
| 567012 | 974 | 993 | CCAAAATTCTCCATCAAGCC | 41 | N/A | N/A | 2229 |
| 567013 | 975 | 994 | ACCAAAATTCTCCATCAAGC | 49 | N/A | N/A | 2230 |
| 567014 | 978 | 997 | CCAACCAAAATTCTCCATCA | 32 | N/A | N/A | 2231 |
| 567015 | 979 | 998 | CCCAACCAAAATTCTCCATC | 47 | N/A | N/A | 2232 |
| 337497 | 980 | 999 | GCCCAACCAAAATTCTCCAT | 46 | N/A | N/A | 2233 |
| 567016 | 981 | 1000 | GGCCCAACCAAAATTCTCCA | 48 | N/A | N/A | 2234 |
| 567017 | 982 | 1001 | AGGCCCAACCAAAATTCTCC | 30 | 9557 | 9576 | 2235 |
| 567018 | 983 | 1002 | TAGGCCCAACCAAAATTCTC | 0 | 9558 | 9577 | 2236 |
| 567019 | 984 | 1003 | CTAGGCCCAACCAAAATTCT | 31 | 9559 | 9578 | 2237 |
| 567020 | 985 | 1004 | TCTAGGCCCAACCAAAATTC | 39 | 9560 | 9579 | 2238 |
| 233721 | 986 | 1005 | CTCTAGGCCCAACCAAAATT | 15 | 9561 | 9580 | 2239 |
| 567021 | 987 | 1006 | TCTCTAGGCCCAACCAAAAT | 36 | 9562 | 9581 | 2240 |
| 567022 | 988 | 1007 | TTCTCTAGGCCCAACCAAAA | 26 | 9563 | 9582 | 2241 |
| 567023 | 989 | 1008 | CTTCTCTAGGCCCAACCAAA | 44 | 9564 | 9583 | 2242 |
| 567024 | 993 | 1012 | ATATCTTCTCTAGGCCCAAC | 29 | 9568 | 9587 | 2243 |
| 567025 | 994 | 1013 | TATATCTTCTCTAGGCCCAA | 41 | 9569 | 9588 | 2244 |
| 567026 | 995 | 1014 | GTATATCTTCTCTAGGCCCA | 53 | 9570 | 9589 | 2245 |
| 567027 | 1000 | 1019 | ATGGAGTATATCTTCTCTAG | 18 | 9575 | 9594 | 2246 |
| 567028 | 1004 | 1023 | CACTATGGAGTATATCTTCT | 35 | 9579 | 9598 | 2247 |

TABLE 135-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567029 | 1005 | 1024 | TCACTATGGAGTATATCTTC | 9 | 9580 | 9599 | 2248 |
| 567030 | 1006 | 1025 | TTCACTATGGAGTATATCTT | 11 | 9581 | 9600 | 2249 |
| 567031 | 1010 | 1029 | TTGCTTCACTATGGAGTATA | 43 | 9585 | 9604 | 2250 |
| 567032 | 1011 | 1030 | ATTGCTTCACTATGGAGTAT | 4 | 9586 | 9605 | 2251 |
| 567033 | 1015 | 1034 | TTAGATTGCTTCACTATGGA | 17 | 9590 | 9609 | 2252 |
| 567034 | 1016 | 1035 | ATTAGATTGCTTCACTATGG | 35 | 9591 | 9610 | 2253 |
| 567035 | 1017 | 1036 | AATTAGATTGCTTCACTATG | 18 | 9592 | 9611 | 2254 |
| 567036 | 1018 | 1037 | TAATTAGATTGCTTCACTAT | 17 | 9593 | 9612 | 2255 |
| 567037 | 1019 | 1038 | ATAATTAGATTGCTTCACTA | 19 | 9594 | 9613 | 2256 |
| 567038 | 1020 | 1039 | CATAATTAGATTGCTTCACT | 27 | 9595 | 9614 | 2257 |
| 567039 | 1021 | 1040 | ACATAATTAGATTGCTTCAC | 17 | 9596 | 9615 | 2258 |
| 337498 | 1022 | 1041 | AACATAATTAGATTGCTTCA | 9 | 9597 | 9616 | 2259 |
| 567040 | 1023 | 1042 | AAACATAATTAGATTGCTTC | 0 | 9598 | 9617 | 2260 |
| 567041 | 1024 | 1043 | AAAACATAATTAGATTGCTT | 0 | 9599 | 9618 | 2261 |
| 567042 | 1025 | 1044 | TAAAACATAATTAGATTGCT | 23 | 9600 | 9619 | 2262 |
| 567043 | 1026 | 1045 | GTAAAACATAATTAGATTGC | 25 | 9601 | 9620 | 2263 |
| 567044 | 1027 | 1046 | CGTAAAACATAATTAGATTG | 0 | 9602 | 9621 | 2264 |
| 567045 | 1048 | 1067 | TTCCAGTCTTCCAACTCAAT | 9 | 9623 | 9642 | 2265 |
| 337500 | 1050 | 1069 | CTTTCCAGTCTTCCAACTCA | 30 | 9625 | 9644 | 2266 |
| 567046 | 1057 | 1076 | TTGTTGTCTTTCCAGTCTTC | 40 | 9632 | 9651 | 2267 |
| 567047 | 1064 | 1083 | ATAATGTTTGTTGTCTTTCC | 26 | 9639 | 9658 | 2268 |
| 567048 | 1065 | 1084 | TATAATGTTTGTTGTCTTTC | 6 | 9640 | 9659 | 2269 |
| 567049 | 1066 | 1085 | ATATAATGTTTGTTGTCTTT | 9 | 9641 | 9660 | 2270 |
| 567050 | 1069 | 1088 | TCAATATAATGTTTGTTGTC | 20 | 9644 | 9663 | 2271 |
| 567051 | 1073 | 1092 | ATATTCAATATAATGTTTGT | 15 | 9648 | 9667 | 2272 |
| 567052 | 1074 | 1093 | AATATTCAATATAATGTTTG | 16 | 9649 | 9668 | 2273 |
| 567053 | 1075 | 1094 | GAATATTCAATATAATGTTT | 7 | 9650 | 9669 | 2274 |
| 567054 | 1076 | 1095 | AGAATATTCAATATAATGTT | 3 | 9651 | 9670 | 2275 |
| 567055 | 1077 | 1096 | AAGAATATTCAATATAATGT | 7 | 9652 | 9671 | 2276 |
| 567056 | 1085 | 1104 | CAAGTAAAAAGAATATTCAA | 0 | 9660 | 9679 | 2277 |
| 567057 | 1086 | 1105 | CCAAGTAAAAAGAATATTCA | 0 | 9661 | 9680 | 2278 |
| 567058 | 1087 | 1106 | CCCAAGTAAAAAGAATATTC | 13 | 9662 | 9681 | 2279 |
| 567059 | 1090 | 1109 | TTTCCCAAGTAAAAAGAATA | 0 | 9665 | 9684 | 2280 |
| 567060 | 1091 | 1110 | ATTTCCCAAGTAAAAAGAAT | 2 | 9666 | 9685 | 2281 |
| 567061 | 1092 | 1111 | GATTTCCCAAGTAAAAAGAA | 14 | 9667 | 9686 | 2282 |
| 567062 | 1093 | 1112 | TGATTTCCCAAGTAAAAAGA | 14 | 9668 | 9687 | 2283 |
| 567063 | 1127 | 1146 | AATCGCAACTAGATGTAGCG | 15 | 9702 | 9721 | 2284 |
| 563874 | 1586 | 1605 | ATTCTTTAAGGTTATGTGAT | 13 | 10558 | 10577 | 2285 |
| 563875 | 1587 | 1606 | TATTCTTTAAGGTTATGTGA | 25 | 10559 | 10578 | 2286 |
| 563876 | 1591 | 1610 | ACGGTATTCTTTAAGGTTAT | 50 | 10563 | 10582 | 2287 |
| 563877 | 1592 | 1611 | AACGGTATTCTTTAAGGTTA | 48 | 10564 | 10583 | 2288 |
| 563878 | 1593 | 1612 | AAACGGTATTCTTTAAGGTT | 45 | 10565 | 10584 | 2289 |
| 563879 | 1594 | 1613 | TAAACGGTATTCTTTAAGGT | 16 | 10566 | 10585 | 2290 |
| 563880 | 1595 | 1614 | GTAAACGGTATTCTTTAAGG | 14 | 10567 | 10586 | 2291 |
| 563881 | 1596 | 1615 | TGTAAACGGTATTCTTTAAG | 0 | 10568 | 10587 | 2292 |
| 563882 | 1597 | 1616 | ATGTAAACGGTATTCTTTAA | 10 | 10569 | 10588 | 2293 |
| 563883 | 1598 | 1617 | AATGTAAACGGTATTCTTTA | 12 | 10570 | 10589 | 2294 |
| 563884 | 1599 | 1618 | AAATGTAAACGGTATTCTTT | 15 | 10571 | 10590 | 2295 |
| 563885 | 1600 | 1619 | GAAATGTAAACGGTATTCTT | 13 | 10572 | 10591 | 2296 |
| 563886 | 1601 | 1620 | AGAAATGTAAACGGTATTCT | 22 | 10573 | 10592 | 2297 |
| 563887 | 1602 | 1621 | GAGAAATGTAAACGGTATTC | 35 | 10574 | 10593 | 2298 |
| 563888 | 1603 | 1622 | TGAGAAATGTAAACGGTATT | 14 | 10575 | 10594 | 2299 |
| 563889 | 1604 | 1623 | TTGAGAAATGTAAACGGTAT | 0 | 10576 | 10595 | 2300 |
| 563890 | 1605 | 1624 | ATTGAGAAATGTAAACGGTA | 18 | 10577 | 10596 | 2301 |
| 563891 | 1606 | 1625 | GATTGAGAAATGTAAACGGT | 40 | 10578 | 10597 | 2302 |
| 563892 | 1607 | 1626 | TGATTGAGAAATGTAAACGG | 33 | 10579 | 10598 | 2303 |
| 563893 | 1608 | 1627 | TTGATTGAGAAATGTAAACG | 7 | 10580 | 10599 | 2304 |
| 563894 | 1609 | 1628 | TTTGATTGAGAAATGTAAAC | 0 | 10581 | 10600 | 2305 |
| 563895 | 1610 | 1629 | TTTTGATTGAGAAATGTAAA | 0 | 10582 | 10601 | 2306 |
| 563896 | 1611 | 1630 | ATTTTGATTGAGAAATGTAA | 0 | 10583 | 10602 | 2307 |
| 563897 | 1612 | 1631 | AATTTTGATTGAGAAATGTA | 0 | 10584 | 10603 | 2308 |
| 563898 | 1613 | 1632 | GAATTTTGATTGAGAAATGT | 4 | 10585 | 10604 | 2309 |
| 563899 | 1614 | 1633 | AGAATTTTGATTGAGAAATG | 4 | 10586 | 10605 | 2310 |
| 563900 | 1615 | 1634 | AAGAATTTTGATTGAGAAAT | 26 | 10587 | 10606 | 2311 |
| 563901 | 1617 | 1636 | ATAAGAATTTTGATTGAGAA | 4 | 10589 | 10608 | 2312 |
| 563902 | 1618 | 1637 | TATAAGAATTTTGATTGAGA | 0 | 10590 | 10609 | 2313 |
| 563903 | 1619 | 1638 | TTATAAGAATTTTGATTGAG | 0 | 10591 | 10610 | 2314 |
| 563904 | 1620 | 1639 | ATTATAAGAATTTTGATTGA | 0 | 10592 | 10611 | 2315 |
| 563905 | 1621 | 1640 | TATTATAAGAATTTTGATTG | 3 | 10593 | 10612 | 2316 |
| 563906 | 1622 | 1641 | GTATTATAAGAATTTTGATT | 1 | 10594 | 10613 | 2317 |
| 563907 | 1623 | 1642 | AGTATTATAAGAATTTTGAT | 44 | 10595 | 10614 | 2318 |
| 563908 | 1624 | 1643 | TAGTATTATAAGAATTTTGA | 29 | 10596 | 10615 | 2319 |

TABLE 135-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563909 | 1632 | 1651 | AAAACAAATAGTATTATAAG | 11 | 10604 | 10623 | 2320 |
| 563910 | 1633 | 1652 | TAAAACAAATAGTATTATAA | 16 | 10605 | 10624 | 2321 |
| 563911 | 1652 | 1671 | ATTCCCACATCACAAAATTT | 27 | 10624 | 10643 | 2322 |
| 563912 | 1653 | 1672 | GATTCCCACATCACAAAATT | 21 | 10625 | 10644 | 2323 |
| 563913 | 1654 | 1673 | TGATTCCCACATCACAAAAT | 49 | 10626 | 10645 | 2324 |
| 563914 | 1658 | 1677 | AAATTGATTCCCACATCACA | 47 | 10630 | 10649 | 2325 |
| 563915 | 1659 | 1678 | AAAATTGATTCCCACATCAC | 48 | 10631 | 10650 | 2326 |
| 563916 | 1663 | 1682 | ATCTAAAATTGATTCCCACA | 58 | 10635 | 10654 | 2327 |
| 563917 | 1667 | 1686 | GACCATCTAAAATTGATTCC | 41 | 10639 | 10658 | 2328 |
| 563918 | 1668 | 1687 | TGACCATCTAAAATTGATTC | 25 | 10640 | 10659 | 2329 |
| 563919 | 1669 | 1688 | GTGACCATCTAAAATTGATT | 33 | 10641 | 10660 | 2330 |
| 563920 | 1670 | 1689 | TGTGACCATCTAAAATTGAT | 34 | 10642 | 10661 | 2331 |
| 563921 | 1671 | 1690 | TTGTGACCATCTAAAATTGA | 20 | 10643 | 10662 | 2332 |
| 563922 | 1672 | 1691 | ATTGTGACCATCTAAAATTG | 2 | 10644 | 10663 | 2333 |
| 563923 | 1673 | 1692 | GATTGTGACCATCTAAAATT | 43 | 10645 | 10664 | 2334 |
| 563924 | 1674 | 1693 | AGATTGTGACCATCTAAAAT | 39 | 10646 | 10665 | 2335 |
| 563925 | 1675 | 1694 | TAGATTGTGACCATCTAAAA | 36 | 10647 | 10666 | 2336 |
| 563926 | 1676 | 1695 | CTAGATTGTGACCATCTAAA | 56 | 10648 | 10667 | 2337 |
| 563927 | 1677 | 1696 | TCTAGATTGTGACCATCTAA | 37 | 10649 | 10668 | 2338 |
| 563928 | 1678 | 1697 | ATCTAGATTGTGACCATCTA | 46 | 10650 | 10669 | 2339 |
| 563929 | 1679 | 1698 | AATCTAGATTGTGACCATCT | 56 | 10651 | 10670 | 2340 |
| 563930 | 1680 | 1699 | TAATCTAGATTGTGACCATC | 46 | 10652 | 10671 | 2341 |
| 563931 | 1681 | 1700 | ATAATCTAGATTGTGACCAT | 35 | 10653 | 10672 | 2342 |
| 563932 | 1682 | 1701 | TATAATCTAGATTGTGACCA | 45 | 10654 | 10673 | 2343 |
| 563933 | 1683 | 1702 | TTATAATCTAGATTGTGACC | 37 | 10655 | 10674 | 2344 |
| 563934 | 1686 | 1705 | TGATTATAATCTAGATTGTG | 28 | 10658 | 10677 | 2345 |
| 563935 | 1687 | 1706 | TTGATTATAATCTAGATTGT | 0 | 10659 | 10678 | 2346 |
| 563936 | 1688 | 1707 | ATTGATTATAATCTAGATTG | 0 | 10660 | 10679 | 2347 |
| 563937 | 1689 | 1708 | TATTGATTATAATCTAGATT | 0 | 10661 | 10680 | 2348 |
| 563938 | 1690 | 1709 | CTATTGATTATAATCTAGAT | 5 | 10662 | 10681 | 2349 |
| 563939 | 1691 | 1710 | CCTATTGATTATAATCTAGA | 0 | 10663 | 10682 | 2350 |
| 563940 | 1692 | 1711 | ACCTATTGATTATAATCTAG | 9 | 10664 | 10683 | 2351 |
| 563941 | 1693 | 1712 | CACCTATTGATTATAATCTA | 5 | 10665 | 10684 | 2352 |
| 563942 | 1694 | 1713 | TCACCTATTGATTATAATCT | 0 | 10666 | 10685 | 2353 |
| 563943 | 1695 | 1714 | TTCACCTATTGATTATAATC | 10 | 10667 | 10686 | 2354 |
| 563944 | 1696 | 1715 | GTTCACCTATTGATTATAAT | 31 | 10668 | 10687 | 2355 |
| 563945 | 1697 | 1716 | AGTTCACCTATTGATTATAA | 15 | 10669 | 10688 | 2356 |
| 563946 | 1698 | 1717 | AAGTTCACCTATTGATTATA | 31 | 10670 | 10689 | 2357 |
| 563947 | 1700 | 1719 | ATAAGTTCACCTATTGATTA | 9 | 10672 | 10691 | 2358 |
| 563948 | 1701 | 1720 | AATAAGTTCACCTATTGATT | 5 | 10673 | 10692 | 2359 |
| 563949 | 1702 | 1721 | TAATAAGTTCACCTATTGAT | 14 | 10674 | 10693 | 2360 |
| 563950 | 1703 | 1722 | TTAATAAGTTCACCTATTGA | 0 | 10675 | 10694 | 2361 |

TABLE 136

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567064 | N/A | N/A | TGAGTATTCTCGACTTACCT | 26 | 8770 | 8789 | 2362 |
| 567065 | N/A | N/A | AAGTGAGTATTCTCGACTTA | 2 | 8773 | 8792 | 2363 |
| 567066 | N/A | N/A | ATTAAGTGAGTATTCTCGAC | 20 | 8776 | 8795 | 2364 |
| 567067 | N/A | N/A | CCAGAATTAAGTGAGTATTC | 36 | 8781 | 8800 | 2365 |
| 567068 | N/A | N/A | GCTTTCTTACCAGAATTAAG | 75 | 8790 | 8809 | 84 |
| 567069 | N/A | N/A | GTTGCTTTCTTACCAGAATT | 78 | 8793 | 8812 | 85 |
| 567070 | N/A | N/A | TGGGTTGCTTTCTTACCAGA | 26 | 8796 | 8815 | 2366 |
| 567071 | N/A | N/A | AAATGGGTTGCTTTCTTACC | 3 | 8799 | 8818 | 2367 |
| 567072 | N/A | N/A | TACAAATGGGTTGCTTTCTT | 24 | 8802 | 8821 | 2368 |
| 567073 | N/A | N/A | AAGTACAAATGGGTTGCTTT | 24 | 8805 | 8824 | 2369 |
| 567074 | N/A | N/A | GTAAATACAAGTACAAATGG | 7 | 8813 | 8832 | 2370 |
| 567075 | N/A | N/A | TTGCTGGTAAATACAAGTAC | 24 | 8819 | 8838 | 2371 |
| 567076 | N/A | N/A | TAAGGATTGCTGGTAAATAC | 6 | 8825 | 8844 | 2372 |
| 567077 | N/A | N/A | TTTTAAGGATTGCTGGTAAA | 4 | 8828 | 8847 | 2373 |
| 567078 | N/A | N/A | GCTTCATTTAAGGATTGCT | 60 | 8834 | 8853 | 87 |
| 567079 | N/A | N/A | GAAGCTTCATTTTAAGGATT | 0 | 8837 | 8856 | 2374 |

TABLE 136-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567080 | N/A | N/A | TAGGAAGCTTCATTTTAAGG | 9 | 8840 | 8859 | 2375 |
| 567081 | N/A | N/A | TAGTAGGAAGCTTCATTTTA | 18 | 8843 | 8862 | 2376 |
| 567082 | N/A | N/A | TTGAGTTAGTAGGAAGCTTC | 30 | 8849 | 8868 | 2377 |
| 567083 | N/A | N/A | ATTGCTATTGAGTTAGTAGG | 21 | 8856 | 8875 | 2378 |
| 567084 | N/A | N/A | CTTATTGCTATTGAGTTAGT | 28 | 8859 | 8878 | 2379 |
| 567085 | N/A | N/A | ATTGTCTTATTGCTATTGAG | 16 | 8864 | 8883 | 2380 |
| 567086 | N/A | N/A | ACTATTGTCTTATTGCTATT | 10 | 8867 | 8886 | 2381 |
| 567087 | N/A | N/A | TTCACTATTGTCTTATTGCT | 35 | 8870 | 8889 | 2382 |
| 567088 | N/A | N/A | ACATTCACTATTGTCTTATT | 30 | 8873 | 8892 | 2383 |
| 567089 | N/A | N/A | TAAACATTCACTATTGTCTT | 58 | 8876 | 8895 | 2384 |
| 567090 | N/A | N/A | CATTAAACATTCACTATTGT | 28 | 8879 | 8898 | 2385 |
| 567091 | N/A | N/A | GTTTTCATTAAACATTCACT | 54 | 8884 | 8903 | 2386 |
| 567092 | N/A | N/A | AAATACTGTTTTCATTAAAC | 34 | 8891 | 8910 | 2387 |
| 567093 | N/A | N/A | AAAGTATTTATAAAATACTG | 0 | 8903 | 8922 | 2388 |
| 567094 | N/A | N/A | CCTTTTTATTAAAGTATTTA | 0 | 8913 | 8932 | 2389 |
| 567095 | N/A | N/A | CAATCCTTTTTATTAAAGTA | 10 | 8917 | 8936 | 2390 |
| 567096 | N/A | N/A | CTTCATCACAATCCTTTTA | 52 | 8925 | 8944 | 2391 |
| 567097 | N/A | N/A | GTTCTTCATCACAATCCTTT | 57 | 8928 | 8947 | 2392 |
| 567098 | N/A | N/A | ATTGTTCTTCATCACAATCC | 37 | 8931 | 8950 | 2393 |
| 567099 | N/A | N/A | TAGATTGTTCTTCATCACAA | 31 | 8934 | 8953 | 2394 |
| 567100 | N/A | N/A | AAATAGATTGTTCTTCATCA | 11 | 8937 | 8956 | 2395 |
| 567101 | N/A | N/A | AACAAATATAAATAGATTGT | 0 | 8946 | 8965 | 2396 |
| 567102 | N/A | N/A | CAAATAACAAATATAAATAG | 3 | 8951 | 8970 | 2397 |
| 567103 | N/A | N/A | TGGAATTAAAAACAAATAAC | 3 | 8963 | 8982 | 2398 |
| 567104 | N/A | N/A | TTATTGGAATTAAAAACAAA | 12 | 8967 | 8986 | 2399 |
| 567105 | N/A | N/A | TTTTTATTGGAATTAAAAAC | 17 | 8970 | 8989 | 2400 |
| 567106 | N/A | N/A | TAATAACTTTTTTCTGTAAT | 6 | 9001 | 9020 | 2401 |
| 567107 | N/A | N/A | GTTCTTAATAACTTTTTTCT | 21 | 9006 | 9025 | 2402 |
| 567108 | N/A | N/A | AAAAGCATGGTTCTTAATAA | 0 | 9015 | 9034 | 2403 |
| 567109 | N/A | N/A | AAATTTAAAAGCATGGTTCT | 0 | 9021 | 9040 | 2404 |
| 567110 | N/A | N/A | AGGAATAAATTTAAAAAATC | 0 | 9046 | 9065 | 2405 |
| 567111 | N/A | N/A | AGACAGGAATAAATTTAAAA | 7 | 9050 | 9069 | 2406 |
| 567112 | N/A | N/A | AAAAGACAGGAATAAATTTA | 0 | 9053 | 9072 | 2407 |
| 567113 | N/A | N/A | CTTTCTTTGTAGAAAAAGAC | 29 | 9066 | 9085 | 2408 |
| 567114 | N/A | N/A | ATGCTTTCTTTGTAGAAAAA | 12 | 9069 | 9088 | 2409 |
| 567115 | N/A | N/A | GCTTAATGTATGCTTTCTTT | 67 | 9078 | 9097 | 88 |
| 567116 | N/A | N/A | TTTGCTTAATGTATGCTTTC | 21 | 9081 | 9100 | 2410 |
| 567117 | N/A | N/A | GTATTTGCTTAATGTATGCT | 0 | 9084 | 9103 | 2411 |
| 567118 | N/A | N/A | TTGGTATTTGCTTAATGTAT | 0 | 9087 | 9106 | 2412 |
| 567119 | N/A | N/A | CCTTTGGTATTTGCTTAATG | 35 | 9090 | 9109 | 2413 |
| 567120 | N/A | N/A | TGGCCTTTGGTATTTGCTTA | 0 | 9093 | 9112 | 2414 |
| 567121 | N/A | N/A | TAAACCTGGCCTTTGGTATT | 27 | 9099 | 9118 | 2415 |
| 567122 | N/A | N/A | ATGTAAACCTGGCCTTTGGT | 16 | 9102 | 9121 | 2416 |
| 567123 | N/A | N/A | CAAATGTAAACCTGGCCTTT | 0 | 9105 | 9124 | 2417 |
| 567124 | N/A | N/A | CTTCAAATGTAAACCTGGCC | 25 | 9108 | 9127 | 2418 |
| 567125 | N/A | N/A | TTTCTTCAAATGTAAACCTG | 2 | 9111 | 9130 | 2419 |
| 567126 | N/A | N/A | TGTCACTTTCTTCAAATGTA | 57 | 9117 | 9136 | 2420 |
| 567127 | N/A | N/A | TAATGTCACTTTCTTCAAAT | 6 | 9120 | 9139 | 2421 |
| 567128 | N/A | N/A | AATAATAATGTCACTTTCTT | 3 | 9125 | 9144 | 2422 |
| 567129 | N/A | N/A | GAGTAATAATAATGTCACTT | 18 | 9129 | 9148 | 2423 |
| 567130 | N/A | N/A | GACTTGAGTAATAATAATGT | 1 | 9134 | 9153 | 2424 |
| 567131 | N/A | N/A | CCTAGAGACTTGAGTAATAA | 32 | 9140 | 9159 | 2425 |
| 567132 | N/A | N/A | ATTCCTAGAGACTTGAGTAA | 8 | 9143 | 9162 | 2426 |
| 567133 | N/A | N/A | AAGTATTCCTAGAGACTTGA | 11 | 9147 | 9166 | 2427 |
| 567134 | N/A | N/A | GTTAAGTATTCCTAGAGACT | 61 | 9150 | 9169 | 89 |
| 567135 | N/A | N/A | TGTGTTAAGTATTCCTAGAG | 28 | 9153 | 9172 | 2428 |
| 567136 | N/A | N/A | AGAGATGTGTTAAGTATTCC | 31 | 9158 | 9177 | 2429 |
| 567137 | N/A | N/A | GTCAAGAGATGTGTTAAGTA | 52 | 9162 | 9181 | 2430 |
| 567138 | N/A | N/A | ACAGTCAAGAGATGTGTTAA | 22 | 9165 | 9184 | 2431 |
| 567139 | N/A | N/A | TATACAGTCAAGAGATGTGT | 30 | 9168 | 9187 | 2432 |
| 567140 | N/A | N/A | CCATATACAGTCAAGAGATG | 45 | 9171 | 9190 | 2433 |
| 567141 | N/A | N/A | GTAAGTTGAACTAACTACTG | 9 | 7497 | 7516 | 2434 |
| 567142 | N/A | N/A | TGAGTAAGTTGAACTAACTA | 0 | 7500 | 7519 | 2435 |
| 567143 | N/A | N/A | TAATGAGTAAGTTGAACTAA | 2 | 7503 | 7522 | 2436 |
| 567144 | N/A | N/A | AGGTTAATCTTCCTAATACG | 18 | 7523 | 7542 | 2437 |
| 567145 | N/A | N/A | ATAACCAGGTTAATCTTCCT | 34 | 7529 | 7548 | 2438 |
| 567146 | N/A | N/A | ATGATAACCAGGTTAATCTT | 13 | 7532 | 7551 | 2439 |
| 567147 | N/A | N/A | AACAATGATAACCAGGTTAA | 7 | 7536 | 7555 | 2440 |
| 567148 | N/A | N/A | TAAAACAATGATAACCAGGT | 45 | 7539 | 7558 | 2441 |
| 567149 | N/A | N/A | GTATAAAACAATGATAACCA | 26 | 7542 | 7561 | 2442 |
| 567150 | N/A | N/A | CGAATACTCATATATATTTC | 25 | 7572 | 7591 | 2443 |
| 567151 | N/A | N/A | ATACGAATACTCATATATAT | 30 | 7575 | 7594 | 2444 |

TABLE 136-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567152 | N/A | N/A | TTTATACGAATACTCATATA | 32 | 7578 | 7597 | 2445 |
| 567153 | N/A | N/A | ATATTTATACGAATACTCAT | 25 | 7581 | 7600 | 2446 |
| 567154 | N/A | N/A | GTATTATATTTATACGAATA | 0 | 7586 | 7605 | 2447 |
| 567155 | N/A | N/A | AAAAGTATTATATTTATACG | 0 | 7590 | 7609 | 2448 |
| 567156 | N/A | N/A | GGTAAAAGTATTATATTTAT | 0 | 7593 | 7612 | 2449 |
| 567157 | N/A | N/A | ACAAGGTAAAAGTATTATAT | 10 | 7597 | 7616 | 2450 |
| 567158 | N/A | N/A | TAAACAAGGTAAAAGTATTA | 11 | 7600 | 7619 | 2451 |
| 567159 | N/A | N/A | ACATAAACAAGGTAAAAGTA | 3 | 7603 | 7622 | 2452 |
| 567160 | N/A | N/A | TTGAGTAAATACATAAACAA | 12 | 7613 | 7632 | 2453 |
| 567161 | N/A | N/A | GAGAATATTGAGTAAATACA | 4 | 7620 | 7639 | 2454 |
| 567162 | N/A | N/A | AAGGAGAATATTGAGTAAAT | 8 | 7623 | 7642 | 2455 |
| 567163 | N/A | N/A | GAAAAGGAGAATATTGAGTA | 3 | 7626 | 7645 | 2456 |
| 567164 | N/A | N/A | GAGGAAAAGGAGAATATTGA | 19 | 7629 | 7648 | 2457 |
| 567165 | N/A | N/A | TTAGAGGAAAAGGAGAATAT | 41 | 7632 | 7651 | 2458 |
| 567166 | N/A | N/A | ATTATTTTAGAGGAAAAGGA | 30 | 7638 | 7657 | 2459 |
| 567167 | N/A | N/A | CAGATTATTTTAGAGGAAAA | 9 | 7641 | 7660 | 2460 |
| 567168 | N/A | N/A | CTTCAGATTATTTTAGAGGA | 24 | 7644 | 7663 | 2461 |
| 567169 | N/A | N/A | TAGTCACTTCAGATTATTTT | 38 | 7650 | 7669 | 2462 |
| 567170 | N/A | N/A | TAATAGTCACTTCAGATTAT | 13 | 7653 | 7672 | 2463 |
| 567171 | N/A | N/A | TGATAATAGTCACTTCAGAT | 39 | 7656 | 7675 | 2464 |
| 567172 | N/A | N/A | TATTGATAATAGTCACTTCA | 41 | 7659 | 7678 | 2465 |
| 567173 | N/A | N/A | ACTTATTGATAATAGTCACT | 29 | 7662 | 7681 | 2466 |
| 567174 | N/A | N/A | TAAACTTATTGATAATAGTC | 14 | 7665 | 7684 | 2467 |
| 567175 | N/A | N/A | TAGTAAACTTATTGATAATA | 31 | 7668 | 7687 | 2468 |
| 567176 | N/A | N/A | GCATAGTAAACTTATTGATA | 23 | 7671 | 7690 | 2469 |
| 567177 | N/A | N/A | TTGGCATAGTAAACTTATTG | 21 | 7674 | 7693 | 2470 |
| 567178 | N/A | N/A | ATTTTGGCATAGTAAACTTA | 8 | 7677 | 7696 | 2471 |
| 567179 | N/A | N/A | TGAATTTTGGCATAGTAAAC | 5 | 7680 | 7699 | 2472 |
| 567180 | N/A | N/A | TTAATGAATTTTGGCATAGT | 0 | 7684 | 7703 | 2473 |
| 567181 | N/A | N/A | CAATTAATGAATTTTGGCAT | 39 | 7687 | 7706 | 2474 |
| 567182 | N/A | N/A | AAAGGCAATTAATGAATTTT | 12 | 7692 | 7711 | 2475 |
| 567183 | N/A | N/A | GTGAAAGGCAATTAATGAAT | 28 | 7695 | 7714 | 2476 |
| 567184 | N/A | N/A | TTAAGTGAAAGGCAATTAAT | 7 | 7699 | 7718 | 2477 |
| 567185 | N/A | N/A | AAGTTAAGTGAAAGGCAATT | 25 | 7702 | 7721 | 2478 |
| 567186 | N/A | N/A | CCAAAAGTTAAGTGAAAGGC | 50 | 7706 | 7725 | 2479 |
| 567187 | N/A | N/A | GTCCCAAAAGTTAAGTGAAA | 30 | 7709 | 7728 | 2480 |
| 567188 | N/A | N/A | ATGGTCCCAAAAGTTAAGTG | 39 | 7712 | 7731 | 2481 |
| 567189 | N/A | N/A | ATTATGGTCCCAAAAGTTAA | 19 | 7715 | 7734 | 2482 |
| 567190 | N/A | N/A | TTTATTATGGTCCCAAAAGT | 33 | 7718 | 7737 | 2483 |
| 567191 | N/A | N/A | TTATTATTTATTATGGTCCC | 50 | 7724 | 7743 | 2484 |
| 567192 | N/A | N/A | ATGGCAATACATTTTATTAT | 13 | 7737 | 7756 | 2485 |
| 567193 | N/A | N/A | GTTATGGCAATACATTTTAT | 39 | 7740 | 7759 | 2486 |
| 567194 | N/A | N/A | TAATGTTATGGCAATACATT | 0 | 7744 | 7763 | 2487 |
| 567195 | N/A | N/A | TATTAATGTTATGGCAATAC | 22 | 7747 | 7766 | 2488 |
| 567196 | N/A | N/A | GTTTATTAATGTTATGGCAA | 28 | 7750 | 7769 | 2489 |
| 567197 | N/A | N/A | GTAGTTTATTAATGTTATGG | 20 | 7753 | 7772 | 2490 |
| 567198 | N/A | N/A | AAGGTAGTTTATTAATGTTA | 27 | 7756 | 7775 | 2491 |
| 567199 | N/A | N/A | TGTAAGGTAGTTTATTAATG | 0 | 7759 | 7778 | 2492 |
| 567200 | N/A | N/A | TTTTGTAAGGTAGTTTATTA | 0 | 7762 | 7781 | 2493 |
| 567201 | N/A | N/A | TGGTTTTGTAAGGTAGTTTA | 18 | 7765 | 7784 | 2494 |
| 567202 | N/A | N/A | TGGTGGTTTTGTAAGGTAGT | 0 | 7768 | 7787 | 2495 |
| 567203 | N/A | N/A | AATTGGTGGTTTTGTAAGGT | 11 | 7771 | 7790 | 2496 |
| 567204 | N/A | N/A | TTTAATTGGTGGTTTTGTAA | 0 | 7774 | 7793 | 2497 |
| 567205 | N/A | N/A | TTGATTTTAATTGGTGGTTT | 19 | 7779 | 7798 | 2498 |
| 567206 | N/A | N/A | TGTTTGATTTTAATTGGTGG | 26 | 7782 | 7801 | 2499 |
| 567207 | N/A | N/A | ATGTAAATAACACTTTTTTG | 1 | 7804 | 7823 | 2500 |
| 567208 | N/A | N/A | CAGATGTAAATAACACTTTT | 1 | 7807 | 7826 | 2501 |
| 567209 | N/A | N/A | TGACAGATGTAAATAACACT | 21 | 7810 | 7829 | 2502 |
| 567210 | N/A | N/A | ATGTTGACAGATGTAAATAA | 0 | 7814 | 7833 | 2503 |
| 567211 | N/A | N/A | TTTATGTTGACAGATGTAAA | 0 | 7817 | 7836 | 2504 |
| 567212 | N/A | N/A | AGATTTATGTTGACAGATGT | 0 | 7820 | 7839 | 2505 |
| 567213 | N/A | N/A | AGTAGATTTATGTTGACAGA | 19 | 7823 | 7842 | 2506 |
| 567214 | N/A | N/A | TTTAGTAGATTTATGTTGAC | 4 | 7826 | 7845 | 2507 |
| 567215 | N/A | N/A | ATTTTAGTAGATTTATGTT | 0 | 7829 | 7848 | 2508 |
| 567216 | N/A | N/A | CATGTATTTTAGTAGATTT | 5 | 7834 | 7853 | 2509 |
| 567217 | N/A | N/A | GAAATCATGTATTTTAGTA | 0 | 7839 | 7858 | 2510 |
| 567218 | N/A | N/A | ATTGTATTTGATGGATATCT | 43 | 6875 | 6894 | 2511 |
| 567219 | N/A | N/A | GATACATTGTATTTGATGGA | 20 | 6880 | 6899 | 2512 |
| 567220 | N/A | N/A | TAGGTTGATACATTGTATTT | 18 | 6886 | 6905 | 2513 |
| 567221 | N/A | N/A | CAGTTTAGGTTGATACATTG | 18 | 6891 | 6910 | 2514 |
| 567222 | N/A | N/A | GCATCCAGTTTAGGTTGATA | 31 | 6896 | 6915 | 2515 |
| 567223 | N/A | N/A | CCCCAGCATCCAGTTTAGGT | 14 | 6901 | 6920 | 2516 |

TABLE 136-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 567224 | N/A | N/A | AAGAACCCCAGCATCCAGTT | 41 | 6906 | 6925 | 2517 |
| 567225 | N/A | N/A | GTGTAAAAAGAACCCCAGCA | 0 | 6913 | 6932 | 2518 |
| 567226 | N/A | N/A | ATAGGGTGTAAAAAGAACCC | 13 | 6918 | 6937 | 2519 |
| 567227 | N/A | N/A | CTTTTATAGGGTGTAAAAAG | 0 | 6923 | 6942 | 2520 |
| 567228 | N/A | N/A | TATGTCTTTTATAGGGTGTA | 26 | 6928 | 6947 | 2521 |
| 567229 | N/A | N/A | TTAGGTATGTCTTTTATAGG | 0 | 6933 | 6952 | 2522 |
| 567230 | N/A | N/A | TTGTCTTAGGTATGTCTTTT | 30 | 6938 | 6957 | 2523 |
| 567231 | N/A | N/A | CTCTGATTGTCTTAGGTATG | 27 | 6944 | 6963 | 2524 |
| 567232 | N/A | N/A | TATTTCTCTGATTGTCTTAG | 21 | 6949 | 6968 | 2525 |
| 567233 | N/A | N/A | TCCATATTTGTATTTCTCTG | 61 | 6959 | 6978 | 90 |
| 567234 | N/A | N/A | TCAAGTCCATATTTGTATTT | 20 | 6964 | 6983 | 2526 |
| 567235 | N/A | N/A | AATAATCAAGTCCATATTTG | 0 | 6969 | 6988 | 2527 |
| 567236 | N/A | N/A | TTATCTAATAATCAAGTCCA | 0 | 6975 | 6994 | 2528 |
| 567237 | N/A | N/A | CTATATTATCTAATAATCAA | 12 | 6980 | 6999 | 2529 |
| 567238 | N/A | N/A | TAAACCTTCTATATTATCTA | 12 | 6988 | 7007 | 2530 |
| 567239 | N/A | N/A | AATTAATAAACCTTCTATAT | 0 | 6994 | 7013 | 2531 |
| 567240 | N/A | N/A | TAAGTACAGGTTGGACACTG | 0 | 9504 | 9523 | 2532 |
| 567241 | N/A | N/A | GTTATTAAGTACAGGTTGGA | 2 | 9509 | 9528 | 2533 |
| 567242 | N/A | N/A | TGTGAGTTATTAAGTACAGG | 0 | 9514 | 9533 | 2534 |
| 567243 | N/A | N/A | AAATCTGTGAGTTATTAAGT | 0 | 9519 | 9538 | 2535 |
| 567244 | N/A | N/A | GTTTTAAAAATCTGTGAGTT | 19 | 9526 | 9545 | 2536 |
| 567245 | N/A | N/A | CAAAATTCTCCTGAAAAGAA | 20 | 9548 | 9567 | 2537 |
| 567246 | N/A | N/A | CCCAACCAAAATTCTCCTGA | 48 | 9554 | 9573 | 2538 |
| 567247 | N/A | N/A | ACCTGAATAACCCTCTGGAC | 21 | 9807 | 9826 | 2539 |
| 567248 | N/A | N/A | AAGATACCTGAATAACCCTC | 30 | 9812 | 9831 | 2540 |
| 567249 | N/A | N/A | AGAAAAAGATACCTGAATAA | 0 | 9817 | 9836 | 2541 |
| 567250 | N/A | N/A | TGGTATCAGAAAAAGATACC | 0 | 9824 | 9843 | 2542 |
| 567251 | N/A | N/A | AGTATTGGTATCAGAAAAAG | 0 | 9829 | 9848 | 2543 |
| 567252 | N/A | N/A | AATAAAGTATTGGTATCAGA | 10 | 9834 | 9853 | 2544 |
| 567253 | N/A | N/A | ATGAAAATAAAGTATTGGTA | 3 | 9839 | 9858 | 2545 |
| 567254 | N/A | N/A | AGATACTTTGAAGATATGAA | 0 | 9854 | 9873 | 2546 |
| 567255 | N/A | N/A | TGGGAAGATACTTTGAAGAT | 0 | 9859 | 9878 | 2547 |
| 567256 | N/A | N/A | CTAATAATGTGGGAAGATAC | 0 | 9868 | 9887 | 2548 |
| 567257 | N/A | N/A | CATTGCAGATAATAGCTAAT | 0 | 9883 | 9902 | 2549 |
| 567258 | N/A | N/A | AAGTTGTCATTGCAGATAAT | 0 | 9890 | 9909 | 2550 |
| 567259 | N/A | N/A | TTTTAAAAGTTGTCATTGCA | 7 | 9896 | 9915 | 2551 |
| 567260 | N/A | N/A | ATTCGGATTTTTAAAAGTTG | 5 | 9904 | 9923 | 2552 |
| 567261 | N/A | N/A | TTATTTGGGATTCGGATTTT | 15 | 9913 | 9932 | 2553 |
| 567262 | N/A | N/A | TTATAGTTAAGAGGTTTTCG | 27 | 9949 | 9968 | 2554 |
| 567263 | N/A | N/A | TTTCATTATAGTTAAGAGGT | 12 | 9954 | 9973 | 2555 |
| 567264 | N/A | N/A | GAACACTTTCATTATAGTTA | 13 | 9960 | 9979 | 2556 |
| 567265 | N/A | N/A | GAACTAGAATGAACACTTTC | 28 | 9970 | 9989 | 2557 |
| 567266 | N/A | N/A | TGATTGAACTAGAATGAACA | 23 | 9975 | 9994 | 2558 |
| 567267 | N/A | N/A | ATACCTGATTGAACTAGAAT | 9 | 9980 | 9999 | 2559 |
| 567268 | N/A | N/A | GTAAAATACCTGATTGAACT | 6 | 9985 | 10004 | 2560 |
| 567269 | N/A | N/A | TAGAGGTAAAATACCTGATT | 16 | 9990 | 10009 | 2561 |
| 567270 | N/A | N/A | AAGATTAGAGGTAAAATACC | 0 | 9995 | 10014 | 2562 |
| 567271 | N/A | N/A | TGAGGAAGATTAGAGGTAAA | 6 | 10000 | 10019 | 2563 |
| 567272 | N/A | N/A | GAAAATCTGAGGAAGATTAG | 0 | 10007 | 10026 | 2564 |
| 567273 | N/A | N/A | AAATAGAAAATCTGAGGAAG | 0 | 10012 | 10031 | 2565 |
| 567274 | N/A | N/A | ATCTATACACTACCAAAAAA | 0 | 10029 | 10048 | 2566 |
| 567275 | N/A | N/A | AAATAATCTATACACTACCA | 19 | 10034 | 10053 | 2567 |
| 567276 | N/A | N/A | AAATAATCTGTATAAATAAT | 3 | 10047 | 10066 | 2568 |
| 567277 | N/A | N/A | CCCAATTTTAAATAATCTGT | 24 | 10056 | 10075 | 2569 |
| 567278 | N/A | N/A | TAAGTCCCAATTTTAAATAA | 0 | 10061 | 10080 | 2570 |
| 567279 | N/A | N/A | TCTGTATAAGTCCCAATTTT | 15 | 10067 | 10086 | 2571 |
| 567280 | N/A | N/A | AATAATCTGTATAAGTCCCA | 47 | 10072 | 10091 | 2572 |
| 567281 | N/A | N/A | AGTTTTAAATAATCTGTATA | 0 | 10079 | 10098 | 2573 |
| 567282 | N/A | N/A | ATCCCAGTTTTAAATAATCT | 6 | 10084 | 10103 | 2574 |
| 567283 | N/A | N/A | CATGTATCCCAGTTTTAAAT | 6 | 10089 | 10108 | 2575 |
| 567284 | N/A | N/A | TAGATGCATGTATCCCAGTT | 41 | 10095 | 10114 | 2576 |
| 567285 | N/A | N/A | TGTTTTAGATGCATGTATCC | 4 | 10100 | 10119 | 2577 |
| 567286 | N/A | N/A | TACAGTGTTTTAGATGCATG | 25 | 10105 | 10124 | 2578 |
| 567287 | N/A | N/A | AATATTACAGTGTTTTAGAT | 0 | 10110 | 10129 | 2579 |
| 567288 | N/A | N/A | CTTATAAATATTACAGTGTT | 2 | 10116 | 10135 | 2580 |
| 567289 | N/A | N/A | CTTCCTTTCTTATAAATATT | 12 | 10124 | 10143 | 2581 |
| 567290 | N/A | N/A | TTTATCTTCCTTTCTTATAA | 0 | 10129 | 10148 | 2582 |
| 567291 | N/A | N/A | CGTAAGTTTATCTTCCTTTC | 61 | 10135 | 10154 | 91 |
| 567292 | N/A | N/A | TTCCCCGTAAGTTTATCTTC | 22 | 10140 | 10159 | 2583 |
| 567293 | N/A | N/A | TGTATTTCCCCGTAAGTTTA | 0 | 10145 | 10164 | 2584 |
| 567294 | N/A | N/A | GTTACTGTATTTCCCCGTAA | 43 | 10150 | 10169 | 2585 |

TABLE 136-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544120 | 707 | 726 | AGTTCTTGGTGCTCTTGGCT | 80 | 6720 | 6739 | 15 |
| 337487 | 804 | 823 | CACTTGTATGTTCACCTCTG | 80 | 7389 | 7408 | 28 |

TABLE 137

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 563780 | N/A | N/A | TGTTTTCTTCTGGAAGCAGA | 10 | 3100 | 3119 | 2586 |
| 568085 | N/A | N/A | CAGACCTAGACTTCTTAACT | 8 | 3084 | 3103 | 2587 |
| 568086 | N/A | N/A | AGCAGACCTAGACTTCTTAA | 6 | 3086 | 3105 | 2588 |
| 568087 | N/A | N/A | TTTTCTTCTGGAAGCAGACC | 0 | 3098 | 3117 | 2589 |
| 568088 | N/A | N/A | AAACATATATACATGCTTGT | 52 | 11323 | 11342 | 2590 |
| 568089 | N/A | N/A | TTAAACATATATACATGCTT | 39 | 11325 | 11344 | 2591 |
| 568090 | N/A | N/A | GTTTATTGAATTTTAAACAT | 0 | 11337 | 11356 | 2592 |
| 568091 | N/A | N/A | TTGTTTATTGAATTTTAAAC | 9 | 11339 | 11358 | 2593 |
| 568092 | N/A | N/A | CTTTGTTTATTGAATTTTAA | 0 | 11341 | 11360 | 2594 |
| 568093 | N/A | N/A | GTCTTTGTTTATTGAATTTT | 28 | 11343 | 11362 | 2595 |
| 568094 | N/A | N/A | GGGTCTTTGTTTATTGAATT | 0 | 11345 | 11364 | 2596 |
| 568095 | N/A | N/A | CTGGGTCTTTGTTTATTGAA | 11 | 11347 | 11366 | 2597 |
| 568096 | N/A | N/A | GACTGGGTCTTTGTTTATTG | 35 | 11349 | 11368 | 2598 |
| 568097 | N/A | N/A | TTTCTATAATTTAGGGACTG | 12 | 11364 | 11383 | 2599 |
| 568098 | N/A | N/A | AATTTCTATAATTTAGGGAC | 0 | 11366 | 11385 | 2600 |
| 568099 | N/A | N/A | TAAATTTCTATAATTTAGGG | 5 | 11368 | 11387 | 2601 |
| 568100 | N/A | N/A | CAAGAATAATTTAAATTTCT | 38 | 11379 | 11398 | 2602 |
| 568101 | N/A | N/A | GATAAACATGCAAGAATAAT | 1 | 11389 | 11408 | 2603 |
| 568102 | N/A | N/A | TCGATAAACATGCAAGAATA | 51 | 11391 | 11410 | 2604 |
| 568103 | N/A | N/A | TGTCGATAAACATGCAAGAA | 37 | 11393 | 11412 | 2605 |
| 568104 | N/A | N/A | GATGTCGATAAACATGCAAG | 57 | 11395 | 11414 | 2606 |
| 568105 | N/A | N/A | GTGATGTCGATAAACATGCA | 61 | 11397 | 11416 | 2607 |
| 568106 | N/A | N/A | TTGTGATGTCGATAAACATG | 57 | 11399 | 11418 | 2608 |
| 568107 | N/A | N/A | TGTTGTGATGTCGATAAACA | 47 | 11401 | 11420 | 2609 |
| 568108 | N/A | N/A | TCTGTTGTGATGTCGATAAA | 53 | 11403 | 11422 | 2610 |
| 568109 | N/A | N/A | GATCTGTTGTGATGTCGATA | 36 | 11405 | 11424 | 2611 |
| 568110 | N/A | N/A | GGGATCTGTTGTGATGTCGA | 41 | 11407 | 11426 | 2612 |
| 568111 | N/A | N/A | TAGGGATCTGTTGTGATGTC | 43 | 11409 | 11428 | 2613 |
| 568112 | N/A | N/A | TTTAGGGATCTGTTGTGATG | 18 | 11411 | 11430 | 2614 |
| 568113 | N/A | N/A | GATTTAGGGATCTGTTGTGA | 41 | 11413 | 11432 | 2615 |
| 568114 | N/A | N/A | ATCTAATCTTTAGGGATTTA | 37 | 11435 | 11454 | 2616 |
| 568115 | N/A | N/A | TTTGTATCTAATCTTTAGGG | 28 | 11440 | 11459 | 2617 |
| 568116 | N/A | N/A | AATTTGTATCTAATCTTTAG | 0 | 11442 | 11461 | 2618 |
| 568117 | N/A | N/A | GTGGTAAAAAATTTGTATCT | 13 | 11451 | 11470 | 2619 |
| 568118 | N/A | N/A | CTGTGGTAAAAAATTTGTAT | 5 | 11453 | 11472 | 2620 |
| 568119 | N/A | N/A | TACTGTGGTAAAAAATTTGT | 10 | 11455 | 11474 | 2621 |
| 568120 | N/A | N/A | GATACTGTGGTAAAAAATTT | 17 | 11457 | 11476 | 2622 |
| 568121 | N/A | N/A | AGTGATACTGTGGTAAAAAA | 38 | 11460 | 11479 | 2623 |
| 568122 | N/A | N/A | CAAGTGATACTGTGGTAAAA | 58 | 11462 | 11481 | 2624 |
| 568123 | N/A | N/A | GACAAGTGATACTGTGGTAA | 52 | 11464 | 11483 | 2625 |
| 568124 | N/A | N/A | CTGACAAGTGATACTGTGGT | 62 | 11466 | 11485 | 2626 |
| 568125 | N/A | N/A | TTCTGACAAGTGATACTGTG | 27 | 11468 | 11487 | 2627 |
| 568126 | N/A | N/A | AATTCTGACAAGTGATACTG | 33 | 11470 | 11489 | 2628 |
| 568127 | N/A | N/A | ATAAATTCTGACAAGTGATA | 38 | 11473 | 11492 | 2629 |
| 568128 | N/A | N/A | CTGGCAGTTTTAAAAAATCA | 28 | 11502 | 11521 | 2630 |
| 568129 | N/A | N/A | TTCTTACTGGCAGTTTTAAA | 56 | 11508 | 11527 | 2631 |
| 568130 | N/A | N/A | ATTTCTTACTGGCAGTTTTA | 47 | 11510 | 11529 | 2632 |
| 568131 | N/A | N/A | AAATTTCTTACTGGCAGTTT | 53 | 11512 | 11531 | 2633 |
| 568132 | N/A | N/A | TTTAAAATTTCTTACTGGCA | 46 | 11516 | 11535 | 2634 |
| 568133 | N/A | N/A | TTAATTTAAAATTTCTTACT | 9 | 11520 | 11539 | 2635 |
| 568134 | N/A | N/A | CAAATGGGTTTAATTTAAAA | 1 | 11529 | 11548 | 2636 |
| 568135 | N/A | N/A | AACAAATGGGTTTAATTTAA | 11 | 11531 | 11550 | 2637 |
| 568136 | N/A | N/A | TTAACAAATGGGTTTAATTT | 12 | 11533 | 11552 | 2638 |
| 568137 | N/A | N/A | CTTTAACAAATGGGTTTAAT | 27 | 11535 | 11554 | 2639 |
| 568138 | N/A | N/A | TCCTTTAACAAATGGGTTTA | 52 | 11537 | 11556 | 2640 |
| 568139 | N/A | N/A | CTATATCCTTTAACAAATGG | 24 | 11542 | 11561 | 2641 |

TABLE 137-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568140 | N/A | N/A | GGGCACTATATCCTTTAACA | 45 | 11547 | 11566 | 2642 |
| 568141 | N/A | N/A | TTGGGCACTATATCCTTTAA | 20 | 11549 | 11568 | 2643 |
| 568142 | N/A | N/A | TATAACTTGGGCACTATATC | 27 | 11555 | 11574 | 2644 |
| 568143 | N/A | N/A | CATATAACTTGGGCACTATA | 40 | 11557 | 11576 | 2645 |
| 568144 | N/A | N/A | ACCATATAACTTGGGCACTA | 69 | 11559 | 11578 | 103 |
| 568145 | N/A | N/A | TCACCATATAACTTGGGCAC | 60 | 11561 | 11580 | 2646 |
| 568146 | N/A | N/A | GGTCACCATATAACTTGGGC | 73 | 11563 | 11582 | 104 |
| 568147 | N/A | N/A | TAGGTCACCATATAACTTGG | 51 | 11565 | 11584 | 2647 |
| 568148 | N/A | N/A | GGTAGGTCACCATATAACTT | 57 | 11567 | 11586 | 2648 |
| 568149 | N/A | N/A | AAGGTAGGTCACCATATAAC | 52 | 11569 | 11588 | 2649 |
| 568150 | N/A | N/A | CAAAGGTAGGTCACCATATA | 28 | 11571 | 11590 | 2650 |
| 568151 | N/A | N/A | GACAAAGGTAGGTCACCATA | 67 | 11573 | 11592 | 105 |
| 568152 | N/A | N/A | GTATTGACAAAGGTAGGTCA | 55 | 11578 | 11597 | 2651 |
| 568153 | N/A | N/A | AAGTATTGACAAAGGTAGGT | 36 | 11580 | 11599 | 2652 |
| 568154 | N/A | N/A | CTAAGTATTGACAAAGGTAG | 24 | 11582 | 11601 | 2653 |
| 568155 | N/A | N/A | TGCTAAGTATTGACAAAGGT | 49 | 11584 | 11603 | 2654 |
| 568156 | N/A | N/A | AATGCTAAGTATTGACAAAG | 10 | 11586 | 11605 | 2655 |
| 568157 | N/A | N/A | CATAATGCTAAGTATTGACA | 19 | 11589 | 11608 | 2656 |
| 568158 | N/A | N/A | TACATAATGCTAAGTATTGA | 4 | 11591 | 11610 | 2657 |
| 568159 | N/A | N/A | AATACATAATGCTAAGTATT | 1 | 11593 | 11612 | 2658 |
| 568160 | N/A | N/A | GAAATACATAATGCTAAGTA | 23 | 11595 | 11614 | 2659 |
| 568161 | N/A | N/A | TTTGAAATACATAATGCTAA | 8 | 11598 | 11617 | 2660 |
| 568162 | N/A | N/A | GGATAATTTGAAATACATAA | 16 | 11604 | 11623 | 2661 |
| 568163 | N/A | N/A | TTGGATAATTTGAAATACAT | 0 | 11606 | 11625 | 2662 |
| 568164 | N/A | N/A | TATTGGATAATTTGAAATAC | 0 | 11608 | 11627 | 2663 |
| 568165 | N/A | N/A | ATCCAGTTAAAGCTTGTAAA | 46 | 4466 | 4485 | 2664 |
| 568166 | N/A | N/A | TCATGATCCAGTTAAAGCTT | 32 | 4471 | 4490 | 2665 |
| 568167 | N/A | N/A | TTTACTCATGATCCAGTTAA | 24 | 4476 | 4495 | 2666 |
| 568168 | N/A | N/A | GATAATTTTACTCATGATCC | 53 | 4482 | 4501 | 2667 |
| 568169 | N/A | N/A | GATGTGATAATTTTACTCAT | 27 | 4487 | 4506 | 2668 |
| 568170 | N/A | N/A | ATGCTGATGTGATAATTTTA | 42 | 4492 | 4511 | 2669 |
| 568171 | N/A | N/A | CAGTTATGCTGATGTGATAA | 0 | 4497 | 4516 | 2670 |
| 568172 | N/A | N/A | TTTAACAGTTATGCTGATGT | 17 | 4502 | 4521 | 2671 |
| 568173 | N/A | N/A | GCAATTTTAACAGTTATGCT | 11 | 4507 | 4526 | 2672 |
| 568174 | N/A | N/A | AGAGCCTGCAATTTTAACAG | 25 | 4514 | 4533 | 2673 |
| 568175 | N/A | N/A | GCTTCAGAGCCTGCAATTTT | 47 | 4519 | 4538 | 2674 |
| 568176 | N/A | N/A | TATTAGCTTCAGAGCCTGCA | 48 | 4524 | 4543 | 2675 |
| 568177 | N/A | N/A | TAGTTTATTAGCTTCAGAGC | 20 | 4529 | 4548 | 2676 |
| 568178 | N/A | N/A | GCAGGTAGTTTATTAGCTTC | 39 | 4534 | 4553 | 2677 |
| 568179 | N/A | N/A | TAAATGCAGGTAGTTTATTA | 0 | 4539 | 4558 | 2678 |
| 568180 | N/A | N/A | ATGGTTTAAATGCAGGTAGT | 20 | 4545 | 4564 | 2679 |
| 568181 | N/A | N/A | GAGCCATGGTTTAAATGCAG | 33 | 4550 | 4569 | 2680 |
| 568182 | N/A | N/A | TTTTAGAGCCATGGTTTAAA | 40 | 4555 | 4574 | 2681 |
| 568183 | N/A | N/A | CAAAGTTTTAGAGCCATGGT | 54 | 4560 | 4579 | 2682 |
| 568184 | N/A | N/A | TCACACAAAGTTTTAGAGCC | 61 | 4565 | 4584 | 2683 |
| 568185 | N/A | N/A | CAAGGTCACACAAAGTTTTA | 17 | 4570 | 4589 | 2684 |
| 568186 | N/A | N/A | GGGTGAAGTAATTTATTCAA | 0 | 4587 | 4606 | 2685 |
| 568187 | N/A | N/A | GTGAGGAAACTGAGAGATAA | 12 | 4609 | 4628 | 2686 |
| 568188 | N/A | N/A | TGTAGTATATGTGAGGAAAC | 38 | 4619 | 4638 | 2687 |
| 568189 | N/A | N/A | ATCTTTGTAGTATATGTGAG | 30 | 4624 | 4643 | 2688 |
| 568190 | N/A | N/A | TTATTATCTTTGTAGTATAT | 19 | 4629 | 4648 | 2689 |
| 568191 | N/A | N/A | TTCTGTTATTATCTTTGTAG | 48 | 4634 | 4653 | 2690 |
| 568192 | N/A | N/A | ATAAGTTCTGTTATTATCTT | 16 | 4639 | 4658 | 2691 |
| 568193 | N/A | N/A | ATCCTATAAGTTCTGTTATT | 22 | 4644 | 4663 | 2692 |
| 568194 | N/A | N/A | CAATAATCCTATAAGTTCTG | 0 | 4649 | 4668 | 2693 |
| 568195 | N/A | N/A | TAAGATGACATTGGCTGCTA | 49 | 4689 | 4708 | 2694 |
| 568196 | N/A | N/A | TTTAGTAAGATGACATTGGC | 32 | 4694 | 4713 | 2695 |
| 568197 | N/A | N/A | TTGAATTTTAGTAAGATGAC | 19 | 4700 | 4719 | 2696 |
| 568198 | N/A | N/A | CTAATTTGAATTTTAGTAAG | 34 | 4705 | 4724 | 2697 |
| 568199 | N/A | N/A | CATGATCTAATTTGAATTTT | 29 | 4711 | 4730 | 2698 |
| 568200 | N/A | N/A | CAAAGAGAAACATGATCTAA | 27 | 4721 | 4740 | 2699 |
| 568201 | N/A | N/A | GTTTTGAGCAAAGAGAAACA | 36 | 4729 | 4748 | 2700 |
| 568202 | N/A | N/A | GTGTGGTTTTGAGCAAAGAG | 3 | 4734 | 4753 | 2701 |
| 568203 | N/A | N/A | AGCTATTGTGTGGTTTTGAG | 13 | 4741 | 4760 | 2702 |
| 568204 | N/A | N/A | TGAAATGGAAAGCTATTGTG | 15 | 4751 | 4770 | 2703 |
| 568205 | N/A | N/A | TATGAGTGAAATGGAAAGCT | 27 | 4757 | 4776 | 2704 |
| 568206 | N/A | N/A | GCCAATATGAGTGAAATGGA | 62 | 4762 | 4781 | 106 |
| 568207 | N/A | N/A | AAAGAGCCAATATGAGTGAA | 25 | 4767 | 4786 | 2705 |
| 568208 | N/A | N/A | TTGGTCTAAAGAGCCAATAT | 42 | 4774 | 4793 | 2706 |
| 568209 | N/A | N/A | GGTAATCTTGGTCTAAAGAG | 29 | 4781 | 4800 | 2707 |
| 568210 | N/A | N/A | GTGAGATGACGAAGGGTTGG | 0 | 4800 | 4819 | 2708 |
| 568211 | N/A | N/A | AGTCAGTGAGATGACGAAGG | 5 | 4805 | 4824 | 2709 |

TABLE 137-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568212 | N/A | N/A | GGTGAAGTCAGTGAGATGAC | 12 | 4810 | 4829 | 2710 |
| 568213 | N/A | N/A | GTAGAGGAGGTGAAGTCAGT | 13 | 4818 | 4837 | 2711 |
| 568214 | N/A | N/A | AACTAGAGTAGAGGAGGTGA | 20 | 4825 | 4844 | 2712 |
| 568215 | N/A | N/A | AGAATAACTAGAGTAGAGGA | 33 | 4830 | 4849 | 2713 |
| 568216 | N/A | N/A | CGGTCAGAATAACTAGAGTA | 39 | 4835 | 4854 | 2714 |
| 568217 | N/A | N/A | TAAAGCGGTCAGAATAACTA | 29 | 4840 | 4859 | 2715 |
| 568218 | N/A | N/A | ACTGGTAAAGCGGTCAGAAT | 17 | 4845 | 4864 | 2716 |
| 568219 | N/A | N/A | TGAATACTGGTAAAGCGGTC | 37 | 4850 | 4869 | 2717 |
| 568220 | N/A | N/A | TGTGTTTGAATACTGGTAAA | 21 | 4856 | 4875 | 2718 |
| 568221 | N/A | N/A | AGTATGTTTGATGTGTTTGA | 25 | 4867 | 4886 | 2719 |
| 568222 | N/A | N/A | GTGGCAGTATGTTTGATGTG | 15 | 4872 | 4891 | 2720 |
| 568223 | N/A | N/A | TTGAGGTGGCAGTATGTTTG | 14 | 4877 | 4896 | 2721 |
| 568224 | N/A | N/A | AGGCTTTGAGGTGGCAGTAT | 33 | 4882 | 4901 | 2722 |
| 568225 | N/A | N/A | GGCAAAGGCTTTGAGGTGGC | 27 | 4887 | 4906 | 2723 |
| 568226 | N/A | N/A | AACAAGGGCAAAGGCTTTGA | 24 | 4893 | 4912 | 2724 |
| 568227 | N/A | N/A | TAGAGGAAACAACAAGGGCA | 24 | 4903 | 4922 | 2725 |
| 568228 | N/A | N/A | CCAGTTAGAGGAAACAACAA | 4 | 4908 | 4927 | 2726 |
| 568229 | N/A | N/A | GATACCAGGGCAGAAGAGCG | 24 | 4930 | 4949 | 2727 |
| 568230 | N/A | N/A | AAATCAGAGAGTGGGCCACG | 24 | 4952 | 4971 | 2728 |
| 568231 | N/A | N/A | CCTAAGGGAAATCAGAGAGT | 19 | 4960 | 4979 | 2729 |
| 568232 | N/A | N/A | ACGACCCTAAGGGAAATCAG | 30 | 4965 | 4984 | 2730 |
| 568233 | N/A | N/A | TGATAACGACCCTAAGGGAA | 0 | 4970 | 4989 | 2731 |
| 568234 | N/A | N/A | TTTTGTTTGATAACGACCCT | 22 | 4977 | 4996 | 2732 |
| 568235 | N/A | N/A | GTCTTCATTGGGAATTTTTT | 37 | 4993 | 5012 | 2733 |
| 568236 | N/A | N/A | TGTAAGTCTTCATTGGGAAT | 23 | 4998 | 5017 | 2734 |
| 568237 | N/A | N/A | GACCTTGTAAGTCTTCATTG | 52 | 5003 | 5022 | 2735 |
| 568238 | N/A | N/A | TAAGTGACCTTGTAAGTCTT | 36 | 5008 | 5027 | 2736 |
| 568239 | N/A | N/A | TTGGTTAAGTGACCTTGTAA | 11 | 5013 | 5032 | 2737 |
| 568240 | N/A | N/A | TGATTTTTGGTTAAGTGACC | 12 | 5019 | 5038 | 2738 |
| 568241 | N/A | N/A | GGTTGTGATTTTTGGTTAAG | 11 | 5024 | 5043 | 2739 |
| 568242 | N/A | N/A | CAGGCGGTTGTGATTTTTGG | 41 | 5029 | 5048 | 2740 |
| 568243 | N/A | N/A | GGGACCAGGCGGTTGTGATT | 22 | 5034 | 5053 | 2741 |
| 568244 | N/A | N/A | CTAAGGAAGTAGAAGTTTTC | 42 | 5060 | 5079 | 2742 |
| 568245 | N/A | N/A | AGTAGCTAAGGAAGTAGAAG | 11 | 5065 | 5084 | 2743 |
| 568246 | N/A | N/A | CAGGAGAAAAGTAGCTAAGG | 36 | 5074 | 5093 | 2744 |
| 568247 | N/A | N/A | GTGTGCAGGAGAAAAGTAGC | 14 | 5079 | 5098 | 2745 |
| 568248 | N/A | N/A | TAAAGGTGAGTGTGCAGGAG | 7 | 5088 | 5107 | 2746 |
| 568249 | N/A | N/A | ATGTTAAATAAAGGTGAGTG | 8 | 5096 | 5115 | 2747 |
| 568250 | N/A | N/A | ATGTTATGTTAAATAAAGGT | 27 | 5101 | 5120 | 2748 |
| 568251 | N/A | N/A | AATTTATGTTATGTTAAATA | 27 | 5106 | 5125 | 2749 |
| 568252 | N/A | N/A | TAACTAAAATTTATGTTATG | 28 | 5113 | 5132 | 2750 |
| 568253 | N/A | N/A | GATAAATAACTAAAATTTAT | 32 | 5119 | 5138 | 2751 |
| 568254 | N/A | N/A | TTTAGTGCAGGAATAGAAGA | 33 | 5139 | 5158 | 2752 |
| 568255 | N/A | N/A | AATCCCTGTATTCACAGAGC | 68 | 5165 | 5184 | 2753 |
| 568256 | N/A | N/A | GAAAAAATCCCTGTATTCAC | 0 | 5170 | 5189 | 2754 |
| 568257 | N/A | N/A | TAATGGAAAAAATCCCTGTA | 8 | 5175 | 5194 | 2755 |
| 568258 | N/A | N/A | AAATATGAAGATAATGGAAA | 26 | 5186 | 5205 | 2756 |
| 568259 | N/A | N/A | ATAATGGAAAATATGAAGAT | 18 | 5194 | 5213 | 2757 |
| 568260 | N/A | N/A | TATACAAATAATGGAAAATA | 30 | 5201 | 5220 | 2758 |
| 568261 | N/A | N/A | TTCTGGAGTATATACAAATA | 45 | 5211 | 5230 | 2759 |
| 568262 | N/A | N/A | ATTCTATATTCTGGAGTATA | 40 | 5219 | 5238 | 2760 |
| 568263 | N/A | N/A | CCATACAGTATTCTATATTC | 57 | 5228 | 5247 | 2761 |
| 568264 | N/A | N/A | CTGTGTGCCATACAGTATTC | 28 | 5235 | 5254 | 2762 |
| 568265 | N/A | N/A | GCCTACTGTGTGCCATACAG | 60 | 5240 | 5259 | 2763 |
| 568266 | N/A | N/A | AGAAATGCCTACTGTGTGCC | 42 | 5246 | 5265 | 2764 |
| 568267 | N/A | N/A | TCAACAGAAATGCCTACTGT | 52 | 5251 | 5270 | 2765 |
| 568268 | N/A | N/A | ATTAATTCAACAGAAATGCC | 46 | 5257 | 5276 | 2766 |
| 568269 | N/A | N/A | GACATTACATTTATTAATTC | 32 | 5269 | 5288 | 2767 |
| 568270 | N/A | N/A | GTGAATATGACATTACATTT | 32 | 5277 | 5296 | 2768 |
| 568271 | N/A | N/A | CTTCTGTGTGAATATGACAT | 50 | 5284 | 5303 | 2769 |
| 568272 | N/A | N/A | ACACGCTTCTGTGTGAATAT | 43 | 5289 | 5308 | 2770 |
| 568273 | N/A | N/A | ATAGCACACGCTTCTGTGTG | 31 | 5294 | 5313 | 2771 |
| 568274 | N/A | N/A | TAATCATAGCACACGCTTCT | 40 | 5299 | 5318 | 2772 |
| 568275 | N/A | N/A | AATAATAATCATAGCACACG | 20 | 5304 | 5323 | 2773 |
| 568276 | N/A | N/A | CCAAGTAATAATAATCATAG | 35 | 5310 | 5329 | 2774 |
| 568277 | N/A | N/A | CTAGTAATCCAAGTAATAAT | 38 | 5318 | 5337 | 2775 |
| 568278 | N/A | N/A | TATTTCTAGTAATCCAAGTA | 39 | 5323 | 5342 | 2776 |
| 568279 | N/A | N/A | CACACTATTTCTAGTAATCC | 51 | 5328 | 5347 | 2777 |
| 568280 | N/A | N/A | TTATGAGGCACACTATTTCT | 25 | 5336 | 5355 | 2778 |
| 568281 | N/A | N/A | TTTAATTATGAGGCACACTA | 35 | 5341 | 5360 | 2779 |
| 568282 | N/A | N/A | GTTGACCTTTAATTATGAGG | 63 | 5348 | 5367 | 2780 |
| 568283 | N/A | N/A | TTACATTGTTGAATGTTGAC | 45 | 5362 | 5381 | 2781 |

TABLE 137-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568284 | N/A | N/A | ATTAATTACATTGTTGAATG | 31 | 5367 | 5386 | 2782 |
| 568285 | N/A | N/A | TGTAGATTAATTACATTGTT | 49 | 5372 | 5391 | 2783 |
| 568286 | N/A | N/A | TACATTGTAGATTAATTACA | 43 | 5377 | 5396 | 2784 |
| 568287 | N/A | N/A | AGATGTTTACATTGTAGATT | 28 | 5384 | 5403 | 2785 |
| 568288 | N/A | N/A | TTCACCAGATGTTTACATTG | 36 | 5390 | 5409 | 2786 |
| 568289 | N/A | N/A | GTCACTTCACCAGATGTTTA | 65 | 5395 | 5414 | 2787 |
| 568290 | N/A | N/A | CCTCTGTCACTTCACCAGAT | 67 | 5400 | 5419 | 2788 |
| 568291 | N/A | N/A | GCTTCCCTCTGTCACTTCAC | 70 | 5405 | 5424 | 2789 |
| 568292 | N/A | N/A | CAAGTGCTTCCCTCTGTCAC | 33 | 5410 | 5429 | 2790 |
| 568293 | N/A | N/A | TTTCTAAACAAGTGCTTCCC | 70 | 5418 | 5437 | 107 |
| 568294 | N/A | N/A | GCTTTTTTCTAAACAAGTGC | 45 | 5423 | 5442 | 2791 |
| 568295 | N/A | N/A | ACATAGCTTTTTCTAAACA | 9 | 5428 | 5447 | 2792 |
| 568296 | N/A | N/A | TTCTGACATAGCTTTTTCT | 23 | 5433 | 5452 | 2793 |
| 568297 | N/A | N/A | ATGGATTCTGACATAGCTTT | 46 | 5438 | 5457 | 2794 |
| 568298 | N/A | N/A | AATACATGGATTCTGACATA | 37 | 5443 | 5462 | 2795 |
| 568299 | N/A | N/A | ATTAGAATACATGGATTCTG | 57 | 5448 | 5467 | 2796 |
| 568300 | N/A | N/A | CTGCATATTAGAATACATGG | 75 | 5454 | 5473 | 108 |
| 568301 | N/A | N/A | TTGTACTGCATATTAGAATA | 53 | 5459 | 5478 | 2797 |
| 568302 | N/A | N/A | AACTATTGTACTGCATATTA | 25 | 5464 | 5483 | 2798 |
| 568303 | N/A | N/A | TTTTAAACTATTGTACTGCA | 25 | 5469 | 5488 | 2799 |
| 568304 | N/A | N/A | TGAGAGTATTATTAATATTT | 8 | 5487 | 5506 | 2800 |
| 568305 | N/A | N/A | GCTGTTTGAGAGTATTATTA | 50 | 5493 | 5512 | 2801 |
| 568306 | N/A | N/A | GAATAGCTGTTTGAGAGTAT | 38 | 5498 | 5517 | 2802 |
| 568307 | N/A | N/A | CCTCTTGAATAGCTGTTTGA | 55 | 5504 | 5523 | 2803 |
| 568308 | N/A | N/A | TGAATCCTCTTGAATAGCTG | 55 | 5509 | 5528 | 2804 |
| 568309 | N/A | N/A | TTTTTTGAATCCTCTTGAAT | 46 | 5514 | 5533 | 2805 |
| 568310 | N/A | N/A | TTATGTTTTTTGAATCCTCT | 36 | 5519 | 5538 | 2806 |
| 568311 | N/A | N/A | GTTTATATTATGTTTTTTGA | 6 | 5526 | 5545 | 2807 |
| 568312 | N/A | N/A | TCTGAGTTTATATTATGTTT | 29 | 5531 | 5550 | 2808 |
| 568313 | N/A | N/A | CAGTTTCTCTGAGTTTATAT | 28 | 5538 | 5557 | 2809 |
| 568314 | N/A | N/A | GTTTACCAGTTTCTCTGAGT | 44 | 5544 | 5563 | 2810 |
| 568315 | N/A | N/A | ATTTTGTTTACCAGTTTCTC | 58 | 5549 | 5568 | 2811 |
| 568316 | N/A | N/A | AAAATGATTTTGTTTACCAGT | 29 | 5554 | 5573 | 2812 |
| 568317 | N/A | N/A | CTCTTGAAAATGATTTTGTT | 22 | 5561 | 5580 | 2813 |
| 568318 | N/A | N/A | TATATCTCTTGAAAATGATT | 5 | 5566 | 5585 | 2814 |
| 568319 | N/A | N/A | CAGGTTGGCAAGTTTGTTTG | 27 | 6175 | 6194 | 2815 |
| 568320 | N/A | N/A | GTTGGCAGGTTGGCAAGTTT | 44 | 6180 | 6199 | 2816 |
| 568321 | N/A | N/A | ATATCTGTAGATGTTGGCAG | 59 | 6192 | 6211 | 2817 |
| 568322 | N/A | N/A | TAAACATATCTGTAGATGTT | 18 | 6197 | 6216 | 2818 |
| 568323 | N/A | N/A | ACCTGTAAACATATCTGTAG | 57 | 6202 | 6221 | 2819 |
| 568324 | N/A | N/A | TTTTGACCTGTAAACATATC | 23 | 6207 | 6226 | 2820 |
| 568325 | N/A | N/A | ATAATTTTTGACCTGTAAAC | 7 | 6212 | 6231 | 2821 |
| 568326 | N/A | N/A | TAATTTGATAATTTTTGACC | 7 | 6219 | 6238 | 2822 |
| 568327 | N/A | N/A | TTCTTGATAATTTGATAATT | 8 | 6226 | 6245 | 2823 |
| 568328 | N/A | N/A | ACCAGGCTTTCTTGATAATT | 55 | 6234 | 6253 | 2824 |
| 568329 | N/A | N/A | TTTGAACCAGGCTTTCTTGA | 49 | 6239 | 6258 | 2825 |
| 568330 | N/A | N/A | CATAATTTGAACCAGGCTTT | 68 | 6244 | 6263 | 109 |
| 568331 | N/A | N/A | AGACATAATACATAATTTGA | 8 | 6254 | 6273 | 2826 |
| 568332 | N/A | N/A | CTGTGATAAAGACATAATAC | 40 | 6263 | 6282 | 2827 |
| 568333 | N/A | N/A | CAGACCTGTGATAAAGACAT | 16 | 6268 | 6287 | 2828 |
| 568334 | N/A | N/A | ATCTTCAGACCTGTGATAAA | 7 | 6273 | 6292 | 2829 |
| 568335 | N/A | N/A | TACTGATCTTCAGACCTGTG | 47 | 6278 | 6297 | 2830 |
| 568336 | N/A | N/A | TTAATAATTTTCAGTTTTAG | 35 | 6302 | 6321 | 2831 |
| 568337 | N/A | N/A | TAAGTTTAATAATTTTCAGT | 23 | 6307 | 6326 | 2832 |
| 568338 | N/A | N/A | TTCAGATTTTAAGTTTAATA | 10 | 6316 | 6335 | 2833 |
| 568339 | N/A | N/A | TATATTTGATATTCTGTTCA | 42 | 6332 | 6351 | 2834 |
| 568340 | N/A | N/A | ATATTGTAATGTATTCTTTT | 0 | 6368 | 6387 | 2835 |
| 568341 | N/A | N/A | TTAGAATATTGTAATGTATT | 19 | 6373 | 6392 | 2836 |
| 568342 | N/A | N/A | TTTGCTTAGAATATTGTAAT | 9 | 6378 | 6397 | 2837 |
| 568343 | N/A | N/A | ACTGCTTTGCTTAGAATATT | 36 | 6383 | 6402 | 2838 |
| 568344 | N/A | N/A | AAGTAGAGACTGCTTTGCTT | 60 | 6391 | 6410 | 2839 |
| 568345 | N/A | N/A | GCAAGGCCAAAAGTAGAGAC | 59 | 6401 | 6420 | 2840 |
| 568346 | N/A | N/A | ACAGAGCAAGGCCAAAAGTA | 45 | 6406 | 6425 | 2841 |
| 568347 | N/A | N/A | GGAAAACAGAGCAAGGCCAA | 49 | 6411 | 6430 | 2842 |
| 568348 | N/A | N/A | TGGTCGGAAAACAGAGCAAG | 38 | 6416 | 6435 | 2843 |
| 568349 | N/A | N/A | GACATTGGTCGGAAAACAGA | 26 | 6421 | 6440 | 2844 |
| 568350 | N/A | N/A | AAGCAGACATTGGTCGGAAA | 50 | 6426 | 6445 | 2845 |
| 568351 | N/A | N/A | CAAGGCAAAAAGCAGACAT | 39 | 6436 | 6455 | 2846 |
| 568352 | N/A | N/A | ATAAAGCAAGGCAAAAAGC | 20 | 6442 | 6461 | 2847 |
| 568353 | N/A | N/A | CATTATTTAATAAGATAAAA | 29 | 6464 | 6483 | 2848 |
| 568354 | N/A | N/A | AAATATTTAATCAGGGACAT | 35 | 6481 | 6500 | 2849 |
| 568355 | N/A | N/A | TGTTCTCAAAATATTTAATC | 32 | 6489 | 6508 | 2850 |

TABLE 137-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568356 | N/A | N/A | GATTACCTGTTCTCAAAATA | 40 | 6496 | 6515 | 2851 |
| 568357 | N/A | N/A | GATTGTACAGATTACCTGTT | 12 | 6505 | 6524 | 2852 |
| 568358 | N/A | N/A | ATTCAGATTGTACAGATTAC | 34 | 6510 | 6529 | 2853 |
| 568359 | N/A | N/A | AAACAGTGTTATTCAGATTG | 32 | 6520 | 6539 | 2854 |
| 568360 | N/A | N/A | TAGATAAACAGTGTTATTCA | 25 | 6525 | 6544 | 2855 |
| 568361 | N/A | N/A | ATATTTAGATAAACAGTGTT | 14 | 6530 | 6549 | 2856 |
| 568362 | N/A | N/A | GTTTGATATTTAGATAAACA | 27 | 6535 | 6554 | 2857 |
| 568363 | N/A | N/A | AACGGTGTTTGATATTTAGA | 33 | 6541 | 6560 | 2858 |
| 568364 | N/A | N/A | GTTATAACGGTGTTTGATAT | 29 | 6546 | 6565 | 2859 |
| 568365 | N/A | N/A | ATAATGTTATAACGGTGTTT | 21 | 6551 | 6570 | 2860 |
| 568366 | N/A | N/A | AGTTCATAATGTTATAACGG | 37 | 6556 | 6575 | 2861 |
| 568367 | N/A | N/A | CTTTCAGTTCATAATGTTAT | 46 | 6561 | 6580 | 2862 |
| 568368 | N/A | N/A | AGTACAGTTTGTCTTTCAGT | 48 | 6573 | 6592 | 2863 |
| 568369 | N/A | N/A | TCAGAAGTACAGTTTGTCTT | 47 | 6578 | 6597 | 2864 |
| 568370 | N/A | N/A | GGATGTCAGAAGTACAGTTT | 46 | 6583 | 6602 | 2865 |
| 568371 | N/A | N/A | GAGTAAGGATGTCAGAAGTA | 45 | 6589 | 6608 | 2866 |
| 568372 | N/A | N/A | GAAATCTGAGTAAGGATGTC | 31 | 6596 | 6615 | 2867 |
| 568373 | N/A | N/A | TACTGAATATACAATTAGGG | 5 | 6616 | 6635 | 2868 |
| 568374 | N/A | N/A | AATGATACTGAATATACAAT | 21 | 6621 | 6640 | 2869 |
| 568375 | N/A | N/A | GAATATAAATCTGTTTTTTA | 19 | 6642 | 6661 | 2870 |
| 568376 | N/A | N/A | TAAAAGAATATAAATCTGTT | 32 | 6647 | 6666 | 2871 |
| 568377 | N/A | N/A | GCTGATAAAAGAATATAAAT | 50 | 6652 | 6671 | 2872 |
| 568378 | N/A | N/A | CCTTCTGAGCTGATAAAAGA | 37 | 6660 | 6679 | 2873 |
| 568379 | N/A | N/A | CTAGTCCTTCTGAGCTGATA | 45 | 6665 | 6684 | 2874 |
| 568380 | N/A | N/A | TTACCATCATGTTTTACATT | 30 | 6770 | 6789 | 2875 |
| 568381 | N/A | N/A | CAAAGTGTCTTACCATCATG | 24 | 6779 | 6798 | 2876 |
| 568382 | N/A | N/A | AAACCCACCAAAGTGTCTTA | 15 | 6787 | 6806 | 2877 |
| 568383 | N/A | N/A | AGAAGGAAACCCACCAAAGT | 22 | 6793 | 6812 | 2878 |
| 568384 | N/A | N/A | AATAATAGCTTCAAGAAGGA | 25 | 6806 | 6825 | 2879 |
| 568385 | N/A | N/A | AATTTGATAATAATAGCTTC | 24 | 6814 | 6833 | 2880 |
| 568386 | N/A | N/A | TAGGGAATTTGATAATAATA | 20 | 6819 | 6838 | 2881 |
| 568387 | N/A | N/A | AAGAATAGGGAATTTGATAA | 0 | 6824 | 6843 | 2882 |
| 568388 | N/A | N/A | GTCCTAAGAATAGGGAATTT | 45 | 6829 | 6848 | 2883 |
| 568389 | N/A | N/A | TAGAACAAGTCCTAAGAATA | 21 | 6837 | 6856 | 2884 |
| 568390 | N/A | N/A | TTAGTCTAGAACAAGTCCTA | 28 | 6843 | 6862 | 2885 |
| 568391 | N/A | N/A | ATCTTTTAGTCTAGAACAAG | 21 | 6848 | 6867 | 2886 |
| 568392 | N/A | N/A | TAACTATCTTTTAGTCTAGA | 13 | 6853 | 6872 | 2887 |
| 568393 | N/A | N/A | ATCTCTTAACTATCTTTTAG | 28 | 6859 | 6878 | 2888 |
| 568394 | N/A | N/A | TGGATATCTCTTAACTATCT | 48 | 6864 | 6883 | 2889 |
| 568395 | N/A | N/A | TTTGATGGATATCTCTTAAC | 35 | 6869 | 6888 | 2890 |
| 544120 | 707 | 726 | AGTTCTTGGTGCTCTTGGCT | 80 | 6720 | 6739 | 15 |
| 337487 | 804 | 823 | CACTTGTATGTTCACCTCTG | 76 | 7389 | 7408 | 28 |
| 568006 | 2014 | 2033 | TTAATTCTGCTTCATTAGGT | 53 | 10986 | 11005 | 2891 |
| 568007 | 2015 | 2034 | TTTAATTCTGCTTCATTAGG | 38 | 10987 | 11006 | 2892 |
| 568008 | 2020 | 2039 | CAGTATTTAATTCTGCTTCA | 56 | 10992 | 11011 | 2893 |
| 568009 | 2021 | 2040 | ACAGTATTTAATTCTGCTTC | 63 | 10993 | 11012 | 2894 |
| 568010 | 2022 | 2041 | TACAGTATTTAATTCTGCTT | 56 | 10994 | 11013 | 2895 |
| 568011 | 2023 | 2042 | ATACAGTATTTAATTCTGCT | 39 | 10995 | 11014 | 2896 |
| 568012 | 2024 | 2043 | AATACAGTATTTAATTCTGC | 21 | 10996 | 11015 | 2897 |
| 568013 | 2025 | 2044 | TAATACAGTATTTAATTCTG | 12 | 10997 | 11016 | 2898 |
| 568014 | 2027 | 2046 | TTTAATACAGTATTTAATTC | 0 | 10999 | 11018 | 2899 |
| 568015 | 2028 | 2047 | TTTTAATACAGTATTTAATT | 15 | 11000 | 11019 | 2900 |
| 568016 | 2031 | 2050 | TTATTTTAATACAGTATTTA | 0 | 11003 | 11022 | 2901 |
| 568017 | 2034 | 2053 | AACTTATTTTAATACAGTAT | 24 | 11006 | 11025 | 2902 |
| 568018 | 2035 | 2054 | GAACTTATTTTAATACAGTA | 21 | 11007 | 11026 | 2903 |
| 568019 | 2036 | 2055 | CGAACTTATTTTAATACAGT | 2 | 11008 | 11027 | 2904 |
| 568020 | 2037 | 2056 | GCGAACTTATTTTAATACAG | 54 | 11009 | 11028 | 2905 |
| 568021 | 2038 | 2057 | AGCGAACTTATTTTAATACA | 35 | 11010 | 11029 | 2906 |
| 568022 | 2039 | 2058 | CAGCGAACTTATTTTAATAC | 50 | 11011 | 11030 | 2907 |
| 568023 | 2040 | 2059 | ACAGCGAACTTATTTTAATA | 34 | 11012 | 11031 | 2908 |
| 568024 | 2041 | 2060 | GACAGCGAACTTATTTTAAT | 52 | 11013 | 11032 | 2909 |
| 568025 | 2042 | 2061 | AGACAGCGAACTTATTTTAA | 58 | 11014 | 11033 | 2910 |
| 568026 | 2044 | 2063 | AAAGACAGCGAACTTATTTT | 32 | 11016 | 11035 | 2911 |
| 568027 | 2045 | 2064 | TAAAGACAGCGAACTTATTT | 26 | 11017 | 11036 | 2912 |
| 568028 | 2048 | 2067 | GTTTAAAGACAGCGAACTTA | 62 | 11020 | 11039 | 2913 |
| 568029 | 2049 | 2068 | TGTTTAAAGACAGCGAACTT | 58 | 11021 | 11040 | 2914 |
| 568030 | 2050 | 2069 | TTGTTTAAAGACAGCGAACT | 52 | 11022 | 11041 | 2915 |
| 568031 | 2051 | 2070 | TTTGTTTAAAGACAGCGAAC | 61 | 11023 | 11042 | 2916 |
| 568032 | 2052 | 2071 | ATTTGTTTAAAGACAGCGAA | 41 | 11024 | 11043 | 2917 |
| 568033 | 2053 | 2072 | CATTTGTTTAAAGACAGCGA | 60 | 11025 | 11044 | 2918 |
| 568034 | 2054 | 2073 | CCATTTGTTTAAAGACAGCG | 88 | 11026 | 11045 | 98 |
| 568035 | 2055 | 2074 | TCCATTTGTTTAAAGACAGC | 57 | 11027 | 11046 | 2919 |

TABLE 137-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 568036 | 2056 | 2075 | CTCCATTTGTTTAAAGACAG | 58 | 11028 | 11047 | 2920 |
| 568037 | 2058 | 2077 | ATCTCCATTTGTTTAAAGAC | 56 | 11030 | 11049 | 2921 |
| 568038 | 2059 | 2078 | CATCTCCATTTGTTTAAAGA | 54 | 11031 | 11050 | 2922 |
| 568039 | 2060 | 2079 | TCATCTCCATTTGTTTAAAG | 62 | 11032 | 11051 | 2923 |
| 568040 | 2061 | 2080 | GTCATCTCCATTTGTTTAAA | 53 | 11033 | 11052 | 2924 |
| 568041 | 2063 | 2082 | TAGTCATCTCCATTTGTTTA | 48 | 11035 | 11054 | 2925 |
| 568042 | 2064 | 2083 | GTAGTCATCTCCATTTGTTT | 44 | 11036 | 11055 | 2926 |
| 568043 | 2065 | 2084 | AGTAGTCATCTCCATTTGTT | 48 | 11037 | 11056 | 2927 |
| 568044 | 2066 | 2085 | TAGTAGTCATCTCCATTTGT | 45 | 11038 | 11057 | 2928 |
| 568045 | 2067 | 2086 | TTAGTAGTCATCTCCATTTG | 66 | 11039 | 11058 | 2929 |
| 568046 | 2068 | 2087 | CTTAGTAGTCATCTCCATTT | 66 | 11040 | 11059 | 2930 |
| 568047 | 2069 | 2088 | ACTTAGTAGTCATCTCCATT | 68 | 11041 | 11060 | 99 |
| 568048 | 2070 | 2089 | GACTTAGTAGTCATCTCCAT | 77 | 11042 | 11061 | 100 |
| 568049 | 2071 | 2090 | TGACTTAGTAGTCATCTCCA | 70 | 11043 | 11062 | 101 |
| 568050 | 2072 | 2091 | GTGACTTAGTAGTCATCTCC | 65 | 11044 | 11063 | 2931 |
| 568051 | 2073 | 2092 | TGTGACTTAGTAGTCATCTC | 49 | 11045 | 11064 | 2932 |
| 568052 | 2074 | 2093 | ATGTGACTTAGTAGTCATCT | 47 | 11046 | 11065 | 2933 |
| 568053 | 2075 | 2094 | AATGTGACTTAGTAGTCATC | 48 | 11047 | 11066 | 2934 |
| 568054 | 2076 | 2095 | CAATGTGACTTAGTAGTCAT | 60 | 11048 | 11067 | 2935 |
| 568055 | 2077 | 2096 | TCAATGTGACTTAGTAGTCA | 54 | 11049 | 11068 | 2936 |
| 568056 | 2078 | 2097 | GTCAATGTGACTTAGTAGTC | 72 | 11050 | 11069 | 102 |
| 568057 | 2079 | 2098 | AGTCAATGTGACTTAGTAGT | 62 | 11051 | 11070 | 2937 |
| 568058 | 2083 | 2102 | TTAAAGTCAATGTGACTTAG | 15 | 11055 | 11074 | 2938 |
| 568059 | 2084 | 2103 | GTTAAAGTCAATGTGACTTA | 28 | 11056 | 11075 | 2939 |
| 568060 | 2085 | 2104 | TGTTAAAGTCAATGTGACTT | 35 | 11057 | 11076 | 2940 |
| 568061 | 2086 | 2105 | ATGTTAAAGTCAATGTGACT | 17 | 11058 | 11077 | 2941 |
| 568062 | 2087 | 2106 | CATGTTAAAGTCAATGTGAC | 27 | 11059 | 11078 | 2942 |
| 568063 | 2089 | 2108 | CTCATGTTAAAGTCAATGTG | 28 | 11061 | 11080 | 2943 |
| 568064 | 2090 | 2109 | CCTCATGTTAAAGTCAATGT | 50 | 11062 | 11081 | 2944 |
| 568066 | 2091 | 2110 | ACCTCATGTTAAAGTCAATG | 48 | 11063 | 11082 | 2945 |
| 568068 | 2092 | 2111 | TACCTCATGTTAAAGTCAAT | 13 | 11064 | 11083 | 2946 |
| 568069 | 2093 | 2112 | ATACCTCATGTTAAAGTCAA | 43 | 11065 | 11084 | 2947 |
| 568072 | 2094 | 2113 | GATACCTCATGTTAAAGTCA | 40 | 11066 | 11085 | 2948 |
| 568073 | 2095 | 2114 | TGATACCTCATGTTAAAGTC | 40 | 11067 | 11086 | 2949 |
| 568075 | 2096 | 2115 | GTGATACCTCATGTTAAAGT | 37 | 11068 | 11087 | 2950 |
| 568077 | 2097 | 2116 | AGTGATACCTCATGTTAAAG | 6 | 11069 | 11088 | 2951 |
| 568078 | 2098 | 2117 | TAGTGATACCTCATGTTAAA | 12 | 11070 | 11089 | 2952 |
| 568079 | 2099 | 2118 | ATAGTGATACCTCATGTTAA | 8 | 11071 | 11090 | 2953 |
| 568080 | 2100 | 2119 | TATAGTGATACCTCATGTTA | 13 | 11072 | 11091 | 2954 |
| 568081 | 2101 | 2120 | GTATAGTGATACCTCATGTT | 41 | 11073 | 11092 | 2955 |
| 568082 | 2102 | 2121 | GGTATAGTGATACCTCATGT | 53 | 11074 | 11093 | 2956 |
| 568083 | 2106 | 2125 | ATAAGGTATAGTGATACCTC | 54 | 11078 | 11097 | 2957 |
| 568084 | 2107 | 2126 | AATAAGGTATAGTGATACCT | 38 | 11079 | 11098 | 2958 |

TABLE 138

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 544120 | 707 | 726 | AGTTCTTGGTGCTCTTGGCT | 83 | 6720 | 6739 | 15 |
| 337487 | 804 | 823 | CACTTGTATGTTCACCTCTG | 81 | 7389 | 7408 | 28 |
| 567295 | 1452 | 1471 | TAATGTTTAAATTATTGCCT | 43 | 10424 | 10443 | 2959 |
| 567296 | 1455 | 1474 | GGTTAATGTTTAAATTATTG | 22 | 10427 | 10446 | 2960 |
| 567297 | 1456 | 1475 | AGGTTAATGTTTAAATTATT | 0 | 10428 | 10447 | 2961 |
| 567298 | 1457 | 1476 | GAGGTTAATGTTTAAATTAT | 0 | 10429 | 10448 | 2962 |
| 567299 | 1458 | 1477 | TGAGGTTAATGTTTAAATTA | 6 | 10430 | 10449 | 2963 |
| 567300 | 1460 | 1479 | AATGAGGTTAATGTTTAAAT | 14 | 10432 | 10451 | 2964 |
| 567301 | 1461 | 1480 | GAATGAGGTTAATGTTTAAA | 5 | 10433 | 10452 | 2965 |
| 567302 | 1462 | 1481 | GGAATGAGGTTAATGTTTAA | 27 | 10434 | 10453 | 2966 |
| 567303 | 1463 | 1482 | TGGAATGAGGTTAATGTTTA | 32 | 10435 | 10454 | 2967 |
| 567304 | 1464 | 1483 | TTGGAATGAGGTTAATGTTT | 37 | 10436 | 10455 | 2968 |
| 567305 | 1465 | 1484 | CTTGGAATGAGGTTAATGTT | 25 | 10437 | 10456 | 2969 |
| 567306 | 1468 | 1487 | TAACTTGGAATGAGGTTAAT | 29 | 10440 | 10459 | 2970 |
| 567307 | 1469 | 1488 | TTAACTTGGAATGAGGTTAA | 44 | 10441 | 10460 | 2971 |

TABLE 138-continued

Inhibition of ANGPTL3 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 337513 | 1470 | 1489 | ATTAACTTGGAATGAGGTTA | 52 | 10442 | 10461 | 2972 |
| 567308 | 1471 | 1490 | CATTAACTTGGAATGAGGTT | 62 | 10443 | 10462 | 2973 |
| 567309 | 1472 | 1491 | ACATTAACTTGGAATGAGGT | 58 | 10444 | 10463 | 2974 |
| 567310 | 1473 | 1492 | CACATTAACTTGGAATGAGG | 78 | 10445 | 10464 | 92 |
| 567311 | 1475 | 1494 | ACCACATTAACTTGGAATGA | 59 | 10447 | 10466 | 2975 |
| 567312 | 1476 | 1495 | GACCACATTAACTTGGAATG | 57 | 10448 | 10467 | 2976 |
| 337514 | 1477 | 1496 | AGACCACATTAACTTGGAAT | 71 | 10449 | 10468 | 2977 |
| 567313 | 1478 | 1497 | TAGACCACATTAACTTGGAA | 43 | 10450 | 10469 | 2978 |
| 567314 | 1479 | 1498 | TTAGACCACATTAACTTGGA | 59 | 10451 | 10470 | 2979 |
| 567315 | 1480 | 1499 | ATTAGACCACATTAACTTGG | 70 | 10452 | 10471 | 2980 |
| 567316 | 1481 | 1500 | TATTAGACCACATTAACTTG | 53 | 10453 | 10472 | 2981 |
| 567317 | 1482 | 1501 | TTATTAGACCACATTAACTT | 49 | 10454 | 10473 | 2982 |
| 567318 | 1483 | 1502 | ATTATTAGACCACATTAACT | 41 | 10455 | 10474 | 2983 |
| 567319 | 1484 | 1503 | GATTATTAGACCACATTAAC | 47 | 10456 | 10475 | 2984 |
| 567320 | 1487 | 1506 | CCAGATTATTAGACCACATT | 86 | 10459 | 10478 | 93 |
| 567321 | 1489 | 1508 | TACCAGATTATTAGACCACA | 85 | 10461 | 10480 | 94 |
| 337516 | 1490 | 1509 | ATACCAGATTATTAGACCAC | 77 | 10462 | 10481 | 86 |
| 567322 | 1491 | 1510 | AATACCAGATTATTAGACCA | 50 | 10463 | 10482 | 2985 |
| 567323 | 1492 | 1511 | TAATACCAGATTATTAGACC | 56 | 10464 | 10483 | 2986 |
| 567324 | 1494 | 1513 | TTTAATACCAGATTATTAGA | 9 | 10466 | 10485 | 2987 |
| 567325 | 1495 | 1514 | ATTTAATACCAGATTATTAG | 24 | 10467 | 10486 | 2988 |
| 567326 | 1496 | 1515 | GATTTAATACCAGATTATTA | 37 | 10468 | 10487 | 2989 |
| 567327 | 1500 | 1519 | TAAGGATTTAATACCAGATT | 60 | 10472 | 10491 | 2990 |
| 567328 | 1507 | 1526 | TTTCTCTTAAGGATTTAATA | 34 | 10479 | 10498 | 2991 |
| 567329 | 1508 | 1527 | CTTTCTCTTAAGGATTTAAT | 46 | 10480 | 10499 | 2992 |
| 567330 | 1509 | 1528 | GCTTTCTCTTAAGGATTTAA | 75 | 10481 | 10500 | 95 |
| 567331 | 1510 | 1529 | AGCTTTCTCTTAAGGATTTA | 59 | 10482 | 10501 | 2993 |
| 567332 | 1511 | 1530 | AAGCTTTCTCTTAAGGATTT | 30 | 10483 | 10502 | 2994 |
| 567333 | 1513 | 1532 | TCAAGCTTTCTCTTAAGGAT | 65 | 10485 | 10504 | 2995 |
| 567334 | 1514 | 1533 | CTCAAGCTTTCTCTTAAGGA | 77 | 10486 | 10505 | 96 |
| 567335 | 1515 | 1534 | TCTCAAGCTTTCTCTTAAGG | 75 | 10487 | 10506 | 97 |
| 567336 | 1516 | 1535 | TTCTCAAGCTTTCTCTTAAG | 59 | 10488 | 10507 | 2996 |
| 567337 | 1517 | 1536 | TTTCTCAAGCTTTCTCTTAA | 52 | 10489 | 10508 | 2997 |
| 567338 | 1521 | 1540 | TCTATTTCTCAAGCTTTCTC | 68 | 10493 | 10512 | 2998 |
| 567339 | 1522 | 1541 | ATCTATTTCTCAAGCTTTCT | 71 | 10494 | 10513 | 2999 |
| 567340 | 1523 | 1542 | AATCTATTTCTCAAGCTTTC | 74 | 10495 | 10514 | 3000 |
| 567341 | 1524 | 1543 | AAATCTATTTCTCAAGCTTT | 63 | 10496 | 10515 | 3001 |
| 567342 | 1525 | 1544 | AAAATCTATTTCTCAAGCTT | 54 | 10497 | 10516 | 3002 |
| 567343 | 1532 | 1551 | GATAAAAAAAATCTATTTCT | 30 | 10504 | 10523 | 3003 |
| 567344 | 1548 | 1567 | TAGACAGTGACTTTAAGATA | 37 | 10520 | 10539 | 3004 |
| 567345 | 1549 | 1568 | ATAGACAGTGACTTTAAGAT | 29 | 10521 | 10540 | 3005 |
| 567346 | 1550 | 1569 | AATAGACAGTGACTTTAAGA | 48 | 10522 | 10541 | 3006 |
| 567347 | 1551 | 1570 | AAATAGACAGTGACTTTAAG | 26 | 10523 | 10542 | 3007 |
| 567348 | 1552 | 1571 | TAAATAGACAGTGACTTTAA | 26 | 10524 | 10543 | 3008 |
| 567349 | 1553 | 1572 | TTAAATAGACAGTGACTTTA | 50 | 10525 | 10544 | 3009 |
| 567350 | 1554 | 1573 | CTTAAATAGACAGTGACTTT | 63 | 10526 | 10545 | 3010 |
| 567351 | 1555 | 1574 | TCTTAAATAGACAGTGACTT | 57 | 10527 | 10546 | 3011 |
| 567352 | 1556 | 1575 | ATCTTAAATAGACAGTGACT | 69 | 10528 | 10547 | 3012 |
| 567353 | 1557 | 1576 | AATCTTAAATAGACAGTGAC | 40 | 10529 | 10548 | 3013 |
| 567354 | 1558 | 1577 | TAATCTTAAATAGACAGTGA | 30 | 10530 | 10549 | 3014 |
| 567355 | 1559 | 1578 | TTAATCTTAAATAGACAGTG | 25 | 10531 | 10550 | 3015 |
| 567356 | 1560 | 1579 | TTTAATCTTAAATAGACAGT | 0 | 10532 | 10551 | 3016 |
| 567357 | 1561 | 1580 | GTTTAATCTTAAATAGACAG | 34 | 10533 | 10552 | 3017 |
| 567358 | 1562 | 1581 | TGTTTAATCTTAAATAGACA | 5 | 10534 | 10553 | 3018 |
| 567359 | 1563 | 1582 | ATGTTTAATCTTAAATAGAC | 0 | 10535 | 10554 | 3019 |
| 567360 | 1567 | 1586 | TTGTATGTTTAATCTTAAAT | 0 | 10539 | 10558 | 3020 |
| 567361 | 1568 | 1587 | ATTGTATGTTTAATCTTAAA | 8 | 10540 | 10559 | 3021 |
| 567362 | 1569 | 1588 | GATTGTATGTTTAATCTTAA | 20 | 10541 | 10560 | 3022 |
| 567363 | 1570 | 1589 | TGATTGTATGTTTAATCTTA | 29 | 10542 | 10561 | 3023 |
| 567364 | 1574 | 1593 | TATGTGATTGTATGTTTAAT | 7 | 10546 | 10565 | 3024 |
| 567365 | 1576 | 1595 | GTTATGTGATTGTATGTTTA | 43 | 10548 | 10567 | 3025 |
| 567366 | 1580 | 1599 | TAAGGTTATGTGATTGTATG | 28 | 10552 | 10571 | 3026 |
| 567367 | 1581 | 1600 | TTAAGGTTATGTGATTGTAT | 31 | 10553 | 10572 | 3027 |
| 567368 | 1585 | 1604 | TTCTTTAAGGTTATGTGATT | 12 | 10557 | 10576 | 3028 |

Example 117

Dose-Dependent Antisense Inhibition of Human ANGPTL3 in Hep3B Cells by MOE Gapmers 5-10-5 MOE gapmers from the studies described above exhibiting significant in vitro inhibition of ANGPTL3 mRNA were selected and tested at various doses in Hep3B cells. Cells were plated at a density of 20,000 cells per well and transfected using electroporation with 0.75 µM, 1.50 µM, 3.00 µM, 6.00 µM and 12.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 139

| ISIS No | 0.75 µM | 1.50 µM | 3.00 µM | 6.00 µM | 12.00 µM | IC$_{50}$ (µM) | SEQ ID NO |
|---|---|---|---|---|---|---|---|
| 233717 | 23 | 45 | 13 | 33 | 40 | >12 | 14 |
| 544120 | 45 | 65 | 76 | 88 | 91 | 0.7 | 15 |
| 544145 | 38 | 42 | 61 | 82 | 84 | 1.6 | 16 |
| 544156 | 31 | 42 | 63 | 78 | 84 | 1.8 | 17 |
| 544162 | 35 | 43 | 71 | 76 | 82 | 1.6 | 18 |
| 544166 | 30 | 47 | 60 | 76 | 84 | 1.8 | 19 |
| 544199 | 54 | 61 | 73 | 83 | 84 | 0.5 | 20 |
| 544355 | 45 | 46 | 69 | 77 | 83 | 1.2 | 21 |
| 544368 | 12 | 37 | 63 | 74 | 81 | 2.6 | 22 |
| 544373 | 1 | 27 | 40 | 29 | 28 | >12 | 23 |
| 544376 | 26 | 53 | 61 | 63 | 59 | 2.4 | 24 |
| 544380 | 16 | 33 | 41 | 64 | 39 | 8.4 | 25 |
| 544383 | 14 | 33 | 46 | 61 | 63 | 4.4 | 26 |
| 544410 | 10 | 41 | 48 | 62 | 69 | 3.6 | 27 |

Example 118

Dose-Dependent Antisense Inhibition of Human ANGPTL3 in Hep3B Cells by MOE Gapmers 5-10-5 MOE gapmers from the studies described above exhibiting significant in vitro inhibition of ANGPTL3 mRNA were selected and tested at various doses in Hep3B cells. Cells were plated at a density of 20,000 cells per well and transfected using electroporation with 0.813 µM, 1.625 µM, 3.25 µM, 6.50 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 140

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 17 | 37 | 58 | 72 | 92 | 2.7 | 28 |
| 337492 | 0 | 0 | 0 | 5 | 58 | >13 | 29 |
| 544120 | 23 | 40 | 65 | 81 | 91 | 2.2 | 15 |
| 560236 | 39 | 22 | 46 | 9 | 60 | >13 | 30 |
| 560265 | 38 | 48 | 58 | 64 | 73 | 2.0 | 31 |
| 560268 | 37 | 57 | 60 | 71 | 83 | 1.5 | 32 |
| 560285 | 5 | 29 | 48 | 68 | 78 | 3.8 | 33 |
| 560306 | 45 | 64 | 67 | 81 | 86 | 0.9 | 34 |
| 560400 | 48 | 63 | 75 | 87 | 88 | 0.7 | 35 |
| 560401 | 49 | 75 | 79 | 89 | 88 | 0.5 | 36 |
| 560402 | 42 | 67 | 70 | 85 | 90 | 0.9 | 37 |
| 560469 | 43 | 55 | 70 | 74 | 83 | 1.2 | 38 |
| 560470 | 31 | 54 | 64 | 73 | 81 | 1.8 | 39 |
| 560471 | 26 | 43 | 59 | 62 | 77 | 2.7 | 40 |
| 560474 | 42 | 50 | 60 | 54 | 72 | 1.8 | 41 |

TABLE 141

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 20 | 35 | 51 | 78 | 89 | 1.8 | 28 |
| 544120 | 31 | 46 | 62 | 84 | 90 | 0.5 | 15 |
| 544145 | 4 | 36 | 60 | 58 | 89 | 3.8 | 16 |
| 544156 | 22 | 35 | 46 | 66 | 73 | 1.8 | 17 |
| 544162 | 2 | 21 | 54 | 69 | 87 | >13 | 18 |
| 544166 | 15 | 0 | 25 | 59 | 89 | >13 | 19 |
| 544199 | 61 | 37 | 57 | 53 | 81 | 0.9 | 20 |
| 544355 | 0 | 47 | 50 | 73 | 84 | >13 | 21 |
| 544376 | 4 | 14 | 38 | 66 | 88 | 0.9 | 24 |
| 560566 | 53 | 68 | 70 | 76 | 85 | >13 | 42 |
| 560567 | 55 | 70 | 75 | 78 | 89 | 2.7 | 43 |
| 560574 | 49 | 63 | 68 | 74 | 84 | 2.0 | 44 |
| 560596 | 28 | 40 | 41 | 52 | 75 | 1.5 | 45 |
| 560607 | 35 | 53 | 65 | 70 | 85 | 3.8 | 46 |
| 560608 | 40 | 50 | 62 | 68 | 83 | 0.9 | 47 |
| 560723 | 36 | 51 | 59 | 65 | 75 | 2.2 | 48 |
| 560735 | 36 | 44 | 59 | 72 | 85 | >13 | 49 |
| 560736 | 26 | 34 | 50 | 64 | 80 | 0.7 | 50 |
| 560744 | 28 | 49 | 59 | 75 | 83 | 0.9 | 51 |
| 560778 | 24 | 46 | 60 | 67 | 85 | 1.8 | 52 |
| 560789 | 14 | 23 | 36 | 49 | 71 | 2.7 | 53 |
| 560811 | 32 | 50 | 65 | 73 | 87 | 1.2 | 54 |
| 560856 | 0 | 20 | 17 | 32 | 69 | 3.8 | 55 |
| 560925 | 2 | 16 | 38 | 52 | 82 | 2.7 | 56 |
| 560936 | 0 | 0 | 24 | 41 | 65 | 0.5 | 57 |
| 560938 | 0 | 26 | 30 | 43 | 50 | 0.9 | 58 |
| 560942 | 0 | 0 | 12 | 36 | 74 | 1.8 | 59 |
| 560956 | 0 | 16 | 16 | 68 | 81 | 0.5 | 60 |

TABLE 142

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 20 | 35 | 51 | 78 | 89 | 2.7 | 28 |
| 544120 | 31 | 46 | 62 | 84 | 90 | 1.9 | 15 |
| 560566 | 53 | 68 | 70 | 76 | 85 | 0.5 | 42 |
| 560567 | 55 | 70 | 75 | 78 | 89 | 0.4 | 43 |
| 560574 | 49 | 63 | 68 | 74 | 84 | 0.7 | 44 |
| 560596 | 28 | 40 | 41 | 52 | 75 | 3.9 | 45 |
| 560607 | 35 | 53 | 65 | 70 | 85 | 1.6 | 46 |
| 560608 | 40 | 50 | 62 | 68 | 83 | 1.6 | 47 |
| 560723 | 36 | 51 | 59 | 65 | 75 | 1.9 | 48 |
| 560735 | 36 | 44 | 59 | 72 | 85 | 2.0 | 49 |
| 560736 | 26 | 34 | 50 | 64 | 80 | 3.2 | 50 |
| 560744 | 28 | 49 | 59 | 75 | 83 | 2.1 | 51 |
| 560778 | 24 | 46 | 60 | 67 | 85 | 2.4 | 52 |
| 560789 | 14 | 23 | 36 | 49 | 71 | 5.7 | 53 |
| 560811 | 32 | 50 | 65 | 73 | 87 | 1.8 | 54 |

TABLE 143

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 10 | 21 | 49 | 73 | 90 | 3.4 | 28 |
| 544120 | 19 | 38 | 62 | 77 | 88 | 2.5 | 15 |
| 560768 | 1 | 14 | 14 | 28 | 51 | >13 | 61 |
| 560777 | 13 | 35 | 37 | 56 | 80 | 4.2 | 62 |
| 560791 | 13 | 28 | 28 | 24 | 11 | >13 | 63 |
| 560794 | 8 | 31 | 42 | 57 | 76 | 4.4 | 64 |
| 560799 | 0 | 14 | 21 | 43 | 72 | 7.2 | 65 |
| 560803 | 26 | 44 | 52 | 55 | 69 | 3.4 | 66 |
| 560815 | 16 | 26 | 26 | 52 | 60 | 7.6 | 67 |
| 560817 | 0 | 0 | 11 | 18 | 37 | >13 | 68 |
| 560847 | 37 | 52 | 56 | 68 | 87 | 1.8 | 69 |
| 560879 | 15 | 18 | 38 | 53 | 72 | 5.4 | 70 |
| 560880 | 0 | 8 | 21 | 38 | 71 | 8.0 | 71 |
| 560891 | 7 | 25 | 32 | 35 | 62 | 8.9 | 72 |
| 560895 | 11 | 10 | 0 | 5 | 48 | >13 | 73 |

TABLE 144

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 337487 | 20 | 14 | 38 | 65 | 88 | 3.9 | 28 |
| 544120 | 22 | 34 | 51 | 71 | 86 | 2.9 | 15 |
| 544145 | 21 | 39 | 62 | 63 | 90 | 2.6 | 16 |
| 544156 | 31 | 41 | 55 | 72 | 78 | 2.4 | 17 |
| 544162 | 0 | 37 | 59 | 75 | 87 | 2.7 | 18 |
| 544166 | 8 | 43 | 45 | 55 | 75 | 4.0 | 19 |
| 544199 | 53 | 46 | 64 | 62 | 81 | 1.1 | 20 |
| 544355 | 0 | 0 | 52 | 72 | 84 | 2.9 | 21 |
| 544376 | 2 | 22 | 39 | 51 | 76 | 5.2 | 24 |
| 560856 | 10 | 29 | 36 | 41 | 69 | 6.4 | 55 |
| 560925 | 0 | 35 | 46 | 59 | 81 | 3.5 | 56 |
| 560936 | 18 | 9 | 35 | 55 | 69 | 5.9 | 57 |
| 560938 | 14 | 34 | 42 | 49 | 58 | 6.5 | 58 |
| 560942 | 8 | 13 | 27 | 47 | 77 | 6.1 | 59 |
| 560956 | 16 | 31 | 0 | 69 | 81 | 3.9 | 60 |

TABLE 145

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 11 | 0 | 33 | 58 | 75 | 5.0 | 14 |
| 337484 | 39 | 54 | 55 | 66 | 79 | 1.7 | 74 |
| 337487 | 35 | 42 | 67 | 82 | 92 | 1.8 | 28 |
| 544120 | 53 | 47 | 78 | 84 | 92 | <0.8 | 15 |
| 563523 | 12 | 44 | 59 | 63 | 79 | 3.0 | 75 |
| 563547 | 33 | 51 | 55 | 43 | 58 | 4.6 | 76 |
| 563580 | 61 | 73 | 71 | 82 | 91 | <0.8 | 77 |
| 563637 | 36 | 55 | 69 | 77 | 88 | 1.4 | 78 |
| 563639 | 56 | 71 | 79 | 88 | 93 | <0.8 | 79 |
| 563641 | 30 | 42 | 56 | 77 | 84 | 2.2 | 80 |
| 563669 | 28 | 61 | 66 | 79 | 85 | 1.6 | 81 |
| 563681 | 35 | 67 | 74 | 75 | 70 | 0.9 | 82 |
| 563682 | 41 | 45 | 68 | 76 | 85 | 1.5 | 83 |
| 567068 | 32 | 37 | 50 | 66 | 81 | 2.8 | 84 |
| 567069 | 23 | 28 | 48 | 56 | 62 | 5.0 | 85 |

TABLE 146

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 9 | 0 | 25 | 62 | 74 | 5.5 | 14 |
| 337487 | 22 | 40 | 71 | 84 | 92 | 2.1 | 28 |
| 337516 | 36 | 54 | 78 | 81 | 92 | 1.3 | 86 |
| 544120 | 25 | 50 | 72 | 86 | 92 | 1.8 | 15 |
| 567078 | 54 | 64 | 70 | 78 | 78 | <0.8 | 87 |
| 567115 | 55 | 65 | 72 | 80 | 81 | <0.8 | 88 |
| 567134 | 33 | 58 | 53 | 57 | 69 | 2.2 | 89 |

TABLE 146-continued

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 567233 | 54 | 74 | 83 | 87 | 91 | <0.8 | 90 |
| 567291 | 54 | 67 | 71 | 80 | 89 | <0.8 | 91 |
| 567310 | 36 | 61 | 73 | 80 | 89 | 1.2 | 92 |
| 567320 | 63 | 77 | 88 | 88 | 92 | <0.8 | 93 |
| 567321 | 55 | 75 | 89 | 89 | 93 | <0.8 | 94 |
| 567330 | 31 | 68 | 76 | 85 | 93 | 1.2 | 95 |
| 567334 | 36 | 54 | 76 | 82 | 87 | 1.3 | 96 |
| 567335 | 31 | 49 | 72 | 80 | 92 | 1.7 | 97 |

TABLE 147

| ISIS No | 0.813 µM | 1.625 µM | 3.25 µM | 6.50 µM | 13.00 µM | IC$_{50}$ (µM) | SEQ ID NO |
|---|---|---|---|---|---|---|---|
| 233717 | 0 | 0 | 23 | 66 | 64 | 6.6 | 14 |
| 337487 | 13 | 44 | 60 | 74 | 85 | 2.6 | 28 |
| 544120 | 24 | 47 | 53 | 78 | 83 | 2.3 | 15 |
| 568034 | 35 | 54 | 51 | 59 | 46 | 4.2 | 98 |
| 568047 | 36 | 55 | 70 | 69 | 72 | 1.4 | 99 |
| 568048 | 41 | 64 | 63 | 66 | 66 | 0.9 | 100 |
| 568049 | 50 | 70 | 70 | 74 | 73 | <0.8 | 101 |
| 568056 | 33 | 56 | 68 | 63 | 64 | 1.7 | 102 |
| 568144 | 27 | 57 | 63 | 63 | 76 | 2.0 | 103 |
| 568146 | 50 | 61 | 61 | 63 | 77 | <0.8 | 104 |
| 568151 | 23 | 46 | 59 | 68 | 66 | 2.8 | 105 |
| 568206 | 24 | 40 | 56 | 61 | 75 | 3.0 | 106 |
| 568293 | 0 | 39 | 46 | 59 | 78 | 4.1 | 107 |
| 568300 | 22 | 36 | 61 | 68 | 73 | 3.0 | 108 |
| 568330 | 16 | 48 | 54 | 73 | 82 | 2.7 | 109 |

Example 119

Antisense Inhibition of Human ANGPTL3 in Hep3B Cells by Deoxy, MOE and (S)-cEt Gapmers Additional antisense oligonucleotides were designed targeting an ANGPTL3 nucleic acid and were tested for their effects on ANGPTL3 mRNA in vitro. Cultured Hep3B cells at a density of 20,000 cells per well were transfected using electroporation with 4,500 nM of antisense oligonucleotide. After a treatment period of approximately 24 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as deoxy, MOE, and (S)-cEt oligonucleotides. The deoxy, MOE and (S)-cEt oligonucleotides are 16 nucleosides in length wherein the nucleoside have either a MOE sugar modification, a (S)-cEt sugar modification, or a deoxy sugar residue. The sugar modifications of each antisense oligonucleotide is described as 'eek-d10-kke', where 'k' indicates a (S)-cEt sugar modification; 'd' indicates deoxyribose; the number indicates the number of deoxyribose sugars residues; and 'e' indicates a MOE sugar modification. The internucleoside linkages throughout each oligonucleotide are phosphorothioate (P=S) linkages. All cytosine residues throughout each oligonucleotide are 5-methylcytosines. "Start site" indicates the 5'-most nucleoside to which the oligonucleotide is targeted in the human gene sequence. "Stop site" indicates the 3'-most nucleoside to which the oligonucleotide is targeted human gene sequence. Each oligonucleotide listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 148

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561681 | N/A | N/A | TCTGGAAGCAGACCTA | 37 | 3096 | 3111 | 3029 |
| 561682 | N/A | N/A | CTTCTGGAAGCAGACC | 27 | 3098 | 3113 | 3030 |
| 561683 | N/A | N/A | AAATAAGGTATAGTGA | 2 | 11084 | 11099 | 3031 |
| 561684 | N/A | N/A | TAGTATTAAGTGTTAA | 14 | 11133 | 11148 | 3032 |
| 561685 | N/A | N/A | TCATAGTATTAAGTGT | 0 | 11136 | 11151 | 3033 |
| 561686 | N/A | N/A | AGATTCCTTTACAATT | 21 | 11160 | 11175 | 3034 |
| 561687 | N/A | N/A | ACAAGATTCCTTTACA | 21 | 11163 | 11178 | 3035 |
| 561688 | N/A | N/A | CTGACAAGATTCCTTT | 70 | 11166 | 11181 | 3036 |
| 561689 | N/A | N/A | AATCTGACAAGATTCC | 83 | 11169 | 11184 | 180 |
| 561690 | N/A | N/A | TGTAATCTGACAAGAT | 46 | 11172 | 11187 | 3037 |
| 561691 | N/A | N/A | TACTGTAATCTGACAA | 47 | 11175 | 11190 | 3038 |
| 561692 | N/A | N/A | TCTTACTGTAATCTGA | 50 | 11178 | 11193 | 3039 |
| 561693 | N/A | N/A | CATTCTTACTGTAATC | 40 | 11181 | 11196 | 3040 |
| 561694 | N/A | N/A | GTTCATTCTTACTGTA | 71 | 11184 | 11199 | 3041 |
| 561695 | N/A | N/A | ATATGTTCATTCTTAC | 2 | 11188 | 11203 | 3042 |
| 561696 | N/A | N/A | GCCACAAATATGTTCA | 80 | 11195 | 11210 | 3043 |
| 561697 | N/A | N/A | GATGCCACAAATATGT | 70 | 11198 | 11213 | 3044 |
| 561698 | N/A | N/A | CTCGATGCCACAAATA | 80 | 11201 | 11216 | 181 |
| 561699 | N/A | N/A | TAACTCGATGCCACAA | 86 | 11204 | 11219 | 182 |
| 561700 | N/A | N/A | CTTTAACTCGATGCCA | 77 | 11207 | 11222 | 3045 |
| 561701 | N/A | N/A | AAACTTTAACTCGATG | 39 | 11210 | 11225 | 3046 |
| 561702 | N/A | N/A | TATAAACTTTAACTCG | 13 | 11213 | 11228 | 3047 |
| 561703 | N/A | N/A | CACAGCATATTTAGGG | 71 | 11233 | 11248 | 3048 |
| 561704 | N/A | N/A | TAGAATCACAGCATAT | 68 | 11239 | 11254 | 3049 |
| 561705 | N/A | N/A | TATTAGAATCACAGCA | 73 | 11242 | 11257 | 3050 |
| 561706 | N/A | N/A | AATGTATTAGAATCAC | 40 | 11246 | 11261 | 3051 |
| 561707 | N/A | N/A | ACGAATGTATTAGAAT | 22 | 11249 | 11264 | 3052 |
| 561708 | N/A | N/A | TACACGAATGTATTAG | 33 | 11252 | 11267 | 3053 |
| 561709 | N/A | N/A | ACCTACACGAATGTAT | 42 | 11255 | 11270 | 3054 |
| 561710 | N/A | N/A | AAAACCTACACGAATG | 24 | 11258 | 11273 | 3055 |
| 561711 | N/A | N/A | TTGAAAACCTACACGA | 34 | 11261 | 11276 | 3056 |
| 561712 | N/A | N/A | TACTTGAAAACCTACA | 33 | 11264 | 11279 | 3057 |
| 561713 | N/A | N/A | GTTTATTTCTACTTGA | 53 | 11273 | 11288 | 3058 |
| 561714 | N/A | N/A | GAGGTTTATTTCTACT | 69 | 11276 | 11291 | 3059 |
| 561715 | N/A | N/A | TACGAGGTTTATTTCT | 21 | 11279 | 11294 | 3060 |
| 561716 | N/A | N/A | TGTTACGAGGTTTATT | 47 | 11282 | 11297 | 3061 |
| 561717 | N/A | N/A | ACTTGTTACGAGGTTT | 70 | 11285 | 11300 | 3062 |
| 561718 | N/A | N/A | CAGTAACTTGTTACGA | 60 | 11290 | 11305 | 3063 |
| 561719 | N/A | N/A | GTTCAGTAACTTGTTA | 40 | 11293 | 11308 | 3064 |
| 561720 | N/A | N/A | TCAGGCTGTTTAAACG | 59 | 11308 | 11323 | 3065 |
| 561721 | N/A | N/A | TTGTCAGGCTGTTTAA | 74 | 11311 | 11326 | 3066 |
| 561722 | N/A | N/A | TGCTTGTCAGGCTGTT | 82 | 11314 | 11329 | 183 |
| 561723 | N/A | N/A | ACATGCTTGTCAGGCT | 84 | 11317 | 11332 | 184 |
| 561724 | N/A | N/A | TATACATGCTTGTCAG | 75 | 11320 | 11335 | 3067 |
| 561725 | N/A | N/A | GTCTTTGTTTATTGAA | 49 | 11347 | 11362 | 3068 |
| 561726 | N/A | N/A | TGGGTCTTTGTTTATT | 27 | 11350 | 11365 | 3069 |
| 561727 | N/A | N/A | GACTGGGTCTTTGTTT | 20 | 11353 | 11368 | 3070 |
| 561728 | N/A | N/A | ATAATTTAGGGACTGG | 20 | 11363 | 11378 | 3071 |
| 561729 | N/A | N/A | TCTATAATTTAGGGAC | 39 | 11366 | 11381 | 3072 |
| 561730 | N/A | N/A | CGATAAACATGCAAGA | 68 | 11394 | 11409 | 3073 |
| 561731 | N/A | N/A | TGTCGATAAACATGCA | 80 | 11397 | 11412 | 3074 |
| 561732 | N/A | N/A | TGATGTCGATAAACAT | 68 | 11400 | 11415 | 3075 |
| 561733 | N/A | N/A | TTGTGATGTCGATAAA | 28 | 11403 | 11418 | 3076 |
| 561734 | N/A | N/A | CTGTTGTGATGTCGAT | 74 | 11406 | 11421 | 3077 |
| 561735 | N/A | N/A | GATCTGTTGTGATGTC | 59 | 11409 | 11424 | 3078 |
| 561736 | N/A | N/A | AGGGATCTGTTGTGAT | 24 | 11412 | 11427 | 3079 |
| 561737 | N/A | N/A | TTTAGGGATCTGTTGT | 19 | 11415 | 11430 | 3080 |
| 561738 | N/A | N/A | GGATTTAGGGATCTGT | 27 | 11418 | 11433 | 3081 |
| 561739 | N/A | N/A | GATTTAGGGATTTAGG | 44 | 11425 | 11440 | 3082 |
| 561740 | N/A | N/A | TCTTTAGGGATTTAGG | 38 | 11433 | 11448 | 3083 |
| 561741 | N/A | N/A | TAATCTTTAGGGATTT | 0 | 11436 | 11451 | 3084 |
| 561742 | N/A | N/A | ATCTAATCTTTAGGGA | 0 | 11439 | 11454 | 3085 |
| 561743 | N/A | N/A | TGTATCTAATCTTTAG | 15 | 11442 | 11457 | 3086 |

TABLE 148-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561744 | N/A | N/A | AAATTTGTATCTAATC | 21 | 11447 | 11462 | 3087 |
| 561745 | N/A | N/A | GTAAAAAATTTGTATC | 23 | 11452 | 11467 | 3088 |
| 561746 | N/A | N/A | GTGGTAAAAAATTTGT | 32 | 11455 | 11470 | 3089 |
| 561747 | N/A | N/A | GATACTGTGGTAAAAA | 45 | 11461 | 11476 | 3090 |
| 561748 | N/A | N/A | AGTGATACTGTGGTAA | 60 | 11464 | 11479 | 3091 |
| 561749 | N/A | N/A | ACAAGTGATACTGTGG | 75 | 11467 | 11482 | 3092 |
| 561750 | N/A | N/A | CTGACAAGTGATACTG | 59 | 11470 | 11485 | 3093 |
| 561751 | N/A | N/A | ATTCTGACAAGTGATA | 48 | 11473 | 11488 | 3094 |
| 561752 | N/A | N/A | TAAATTCTGACAAGTG | 59 | 11476 | 11491 | 3095 |
| 561753 | N/A | N/A | TACTGGCAGTTTTAAA | 42 | 11508 | 11523 | 3096 |
| 561754 | N/A | N/A | TCTTACTGGCAGTTTT | 51 | 11511 | 11526 | 3097 |
| 561755 | N/A | N/A | ATTTCTTACTGGCAGT | 69 | 11514 | 11529 | 3098 |
| 561756 | N/A | N/A | AAAATTTCTTACTGGC | 57 | 11517 | 11532 | 3099 |
| 561757 | N/A | N/A | AACAAATGGGTTTAAT | 0 | 11535 | 11550 | 3100 |
| 562374 | N/A | N/A | GAATATTTGCAAGTCT | 68 | 9230 | 9245 | 3101 |
| 562375 | N/A | N/A | GTAGAGGAATATTTGC | 83 | 9236 | 9251 | 151 |
| 562376 | N/A | N/A | TCATTGGTAGAGGAAT | 23 | 9242 | 9257 | 3102 |
| 562377 | N/A | N/A | ATATTTTAAAGTCTCG | 17 | 9258 | 9273 | 3103 |
| 562378 | N/A | N/A | GTTACATTATTATAGA | 29 | 9273 | 9288 | 3104 |
| 562379 | N/A | N/A | GTGAAATGTGTTACAT | 54 | 9282 | 9297 | 3105 |
| 562380 | N/A | N/A | TCACCAGTGAAATGTG | 64 | 9288 | 9303 | 3106 |
| 562381 | N/A | N/A | CATGTTTCACCAGTGA | 78 | 9294 | 9309 | 3107 |
| 562382 | N/A | N/A | ACAAGACATGTTTCAC | 36 | 9300 | 9315 | 3108 |
| 562383 | N/A | N/A | CATATGACAAGACATG | 42 | 9306 | 9321 | 3109 |
| 562384 | N/A | N/A | CTATAATGCATATGAC | 5 | 9314 | 9329 | 3110 |
| 562385 | N/A | N/A | TCCTTTCTATAATGCA | 65 | 9320 | 9335 | 3111 |
| 562386 | N/A | N/A | TGATTATCCTTTCTAT | 27 | 9326 | 9341 | 3112 |
| 562387 | N/A | N/A | AAAGTCTGATTATCCT | 90 | 9332 | 9347 | 152 |
| 562388 | N/A | N/A | TAACTGAAAGTCTGAT | 59 | 9338 | 9353 | 3113 |
| 562389 | N/A | N/A | GTGCACAAAAATGTTA | 42 | 9366 | 9381 | 3114 |
| 562390 | N/A | N/A | AGCTATGTGCACAAAA | 77 | 9372 | 9387 | 3115 |
| 562391 | N/A | N/A | GAAGATAGCTATGTGC | 64 | 9378 | 9393 | 3116 |
| 562392 | N/A | N/A | TTTATTGAAGATAGCT | 33 | 9384 | 9399 | 3117 |
| 562393 | N/A | N/A | TCATTTAGTGTATCT | 40 | 9424 | 9439 | 3118 |
| 562394 | N/A | N/A | CCTTGATCATTTTAGT | 15 | 9430 | 9445 | 3119 |
| 562395 | N/A | N/A | TGAATCCCTTGATCAT | 59 | 9436 | 9451 | 3120 |
| 562396 | N/A | N/A | TAGTCTTGAATCCCTT | 83 | 9442 | 9457 | 153 |
| 562397 | N/A | N/A | GTTGTTTAGTCTTGAA | 65 | 9448 | 9463 | 3121 |
| 562398 | N/A | N/A | AATTGAGTTGTTTAGT | 21 | 9454 | 9469 | 3122 |
| 562399 | N/A | N/A | GCAACTAATTGAGTTG | 15 | 9460 | 9475 | 3123 |
| 562400 | N/A | N/A | ATTGGTGCAACTAATT | 25 | 9466 | 9481 | 3124 |
| 562401 | N/A | N/A | GTTTTTTATTGGTGCA | 53 | 9473 | 9488 | 3125 |
| 562402 | N/A | N/A | GGACACTGACAGTTTT | 43 | 9496 | 9511 | 3126 |
| 562403 | N/A | N/A | CAGGTTGGACACTGAC | 23 | 9502 | 9517 | 3127 |
| 562404 | N/A | N/A | TAAGTACAGGTTGGAC | 33 | 9508 | 9523 | 3128 |
| 562405 | N/A | N/A | AGTTATTAAGTACAGG | 34 | 9514 | 9529 | 3129 |
| 562406 | N/A | N/A | TCTGTGAGTTATTAAG | 10 | 9520 | 9535 | 3130 |
| 562407 | N/A | N/A | ACCAAAATTCTCCTGA | 1 | 9554 | 9569 | 3131 |
| 562408 | N/A | N/A | ACCTGAATAACCCTCT | 73 | 9811 | 9826 | 3132 |
| 562409 | N/A | N/A | GGTATCAGAAAAAGAT | 14 | 9827 | 9842 | 3133 |
| 562410 | N/A | N/A | AGTATTGGTATCAGAA | 13 | 9833 | 9848 | 3134 |
| 562411 | N/A | N/A | GGAAGATACTTTGAAG | 25 | 9861 | 9876 | 3135 |
| 562412 | N/A | N/A | AATGTGGGAAGATACT | 23 | 9867 | 9882 | 3136 |
| 562413 | N/A | N/A | CAGATAATAGCTAATA | 29 | 9882 | 9897 | 3137 |
| 562414 | N/A | N/A | TCATTGCAGATAATAG | 45 | 9888 | 9903 | 3138 |
| 562415 | N/A | N/A | AAGTTGTCATTGCAGA | 86 | 9894 | 9909 | 154 |
| 562416 | N/A | N/A | GATTCGGATTTTAAA | 19 | 9909 | 9924 | 3139 |
| 562417 | N/A | N/A | ATTTGGGATTCGGATT | 34 | 9915 | 9930 | 3140 |
| 562418 | N/A | N/A | ACGCTTATTTGGGATT | 64 | 9921 | 9936 | 3141 |
| 562419 | N/A | N/A | TCTAGAGAGAAAACGC | 64 | 9933 | 9948 | 3142 |
| 562420 | N/A | N/A | AGTTAAGAGGTTTTCG | 34 | 9949 | 9964 | 3143 |
| 562421 | N/A | N/A | CATTATAGTTAAGAGG | 24 | 9955 | 9970 | 3144 |
| 562422 | N/A | N/A | CACTTTCATTATAGTT | 13 | 9961 | 9976 | 3145 |
| 562423 | N/A | N/A | TAGAATGAACACTTTC | 63 | 9970 | 9985 | 3146 |
| 562424 | N/A | N/A | TTGAACTAGAATGAAC | 16 | 9976 | 9991 | 3147 |
| 562425 | N/A | N/A | ACCTGATTGAACTAGA | 51 | 9982 | 9997 | 3148 |
| 562426 | N/A | N/A | TAAAATACCTGATTGA | 19 | 9988 | 10003 | 3149 |
| 562427 | N/A | N/A | TAGAGGTAAAATACCT | 12 | 9994 | 10009 | 3150 |
| 562428 | N/A | N/A | GAAGATTAGAGGTAAA | 1 | 10000 | 10015 | 3151 |
| 562429 | N/A | N/A | TCTGAGGAAGATTAGA | 31 | 10006 | 10021 | 3152 |

TABLE 148-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 562430 | N/A | N/A | TATACACTACCAAAAA | 0 | 10030 | 10045 | 3153 |
| 562431 | N/A | N/A | ATAATCTATACACTAC | 0 | 10036 | 10051 | 3154 |
| 562432 | N/A | N/A | TAAGTCCCAATTTTAA | 33 | 10065 | 10080 | 3155 |
| 562433 | N/A | N/A | TCTGTATAAGTCCCAA | 89 | 10071 | 10086 | 155 |
| 562434 | N/A | N/A | CCAGTTTTAAATAATC | 20 | 10085 | 10100 | 3156 |
| 562435 | N/A | N/A | TGTATCCCAGTTTTAA | 44 | 10091 | 10106 | 3157 |
| 562436 | N/A | N/A | GATGCATGTATCCCAG | 91 | 10097 | 10112 | 156 |
| 562437 | N/A | N/A | GTTTTAGATGCATGTA | 69 | 10103 | 10118 | 3158 |
| 562438 | N/A | N/A | TACAGTGTTTTAGATG | 28 | 10109 | 10124 | 3159 |
| 562439 | N/A | N/A | GTAAGTTTATCTTCCT | 78 | 10138 | 10153 | 157 |
| 562440 | N/A | N/A | TTCCCCGTAAGTTTAT | 33 | 10144 | 10159 | 3160 |
| 562441 | N/A | N/A | CTGTATTTCCCCGTAA | 55 | 10150 | 10165 | 3161 |
| 562442 | N/A | N/A | CTGTTACTGTATTTCC | 79 | 10156 | 10171 | 158 |
| 562443 | N/A | N/A | TAGTTACTGTTACTGT | 70 | 10162 | 10177 | 3162 |
| 562444 | N/A | N/A | CGTATGTAGTTACTGT | 66 | 10168 | 10183 | 3163 |
| 562445 | N/A | N/A | AATGGGTACAGACTCG | 72 | 10182 | 10197 | 3164 |
| 562446 | N/A | N/A | GCAATTTAATGGGTAC | 59 | 10189 | 10204 | 3165 |
| 562447 | N/A | N/A | GATAGATATGCAATTT | 20 | 10198 | 10213 | 3166 |
| 562448 | N/A | N/A | AAAGGAGATAGATATG | 22 | 10204 | 10219 | 3167 |
| 562449 | N/A | N/A | CCTCCTAAAGGAGATA | 42 | 10210 | 10225 | 3168 |
| 562450 | N/A | N/A | CACCAGCCTCCTAAAG | 37 | 10216 | 10231 | 3169 |
| 560990 | 709 | 724 | TTCTTGGTGCTCTTGG | 89 | 6722 | 6737 | 111 |
| 561373 | 1197 | 1212 | TTTGTGATCCCAAGTA | 40 | 9772 | 9787 | 3170 |
| 561374 | 1199 | 1214 | GCTTTGTGATCCCAAG | 76 | 9774 | 9789 | 3171 |
| 561375 | 1201 | 1216 | TTGCTTTGTGATCCCA | 82 | 9776 | 9791 | 3172 |
| 561376 | 1203 | 1218 | TTTTGCTTTGTGATCC | 40 | 9778 | 9793 | 3173 |
| 561377 | 1205 | 1220 | CCTTTTGCTTTGTGAT | 38 | 9780 | 9795 | 3174 |
| 561378 | 1207 | 1222 | GTCCTTTTGCTTTGTG | 75 | 9782 | 9797 | 3175 |
| 561379 | 1209 | 1224 | GTGTCCTTTTGCTTTG | 40 | 9784 | 9799 | 3176 |
| 561527 | 1604 | 1619 | GAAATGTAAACGGTAT | 47 | 10576 | 10591 | 3177 |
| 561528 | 1606 | 1621 | GAGAAATGTAAACGGT | 89 | 10578 | 1059 | 174 |
| 561529 | 1608 | 1623 | TTGAGAAATGTAAACG | 55 | 10580 | 10595 | 3178 |
| 561530 | 1611 | 1626 | TGATTGAGAAATGTAA | 18 | 10583 | 10598 | 3179 |
| 561531 | 1613 | 1628 | TTTGATTGAGAAATGT | 30 | 10585 | 10600 | 3180 |
| 561532 | 1619 | 1634 | AAGAATTTTGATTGAG | 53 | 10591 | 10606 | 3181 |
| 561533 | 1621 | 1636 | ATAAGAATTTTGATTG | 29 | 10593 | 10608 | 3182 |
| 561534 | 1632 | 1647 | CAAATAGTATTATAAG | 6 | 10604 | 10619 | 3183 |
| 561535 | 1653 | 1668 | CCCACATCACAAAATT | 70 | 10625 | 10640 | 3184 |
| 561536 | 1657 | 1672 | GATTCCCACATCACAA | 77 | 10629 | 10644 | 3185 |
| 561537 | 1659 | 1674 | TTGATTCCCACATCAC | 78 | 10631 | 10646 | 3186 |
| 561538 | 1661 | 1676 | AATTGATTCCCACATC | 68 | 10633 | 10648 | 3187 |
| 561539 | 1663 | 1678 | AAAATTGATTCCCACA | 72 | 10635 | 10650 | 3188 |
| 561540 | 1665 | 1680 | CTAAAATTGATTCCCA | 54 | 10637 | 10652 | 3189 |
| 561541 | 1668 | 1683 | CATCTAAAATTGATTC | 0 | 10640 | 10655 | 3190 |
| 561542 | 1670 | 1685 | ACCATCTAAAATTGAT | 35 | 10642 | 10657 | 3191 |
| 561543 | 1672 | 1687 | TGACCATCTAAAATTG | 55 | 10644 | 10659 | 3192 |
| 561544 | 1674 | 1689 | TGTGACCATCTAAAAT | 56 | 10646 | 10661 | 3193 |
| 561545 | 1676 | 1691 | ATTGTGACCATCTAAA | 73 | 10648 | 10663 | 3194 |
| 561546 | 1678 | 1693 | AGATTGTGACCATCTA | 67 | 10650 | 10665 | 3195 |
| 561547 | 1680 | 1695 | CTAGATTGTGACCATC | 50 | 10652 | 10667 | 3196 |
| 561548 | 1682 | 1697 | ATCTAGATTGTGACCA | 77 | 10654 | 10669 | 3197 |
| 561549 | 1684 | 1699 | TAATCTAGATTGTGAC | 55 | 10656 | 10671 | 3198 |
| 561550 | 1686 | 1701 | TATAATCTAGATTGTG | 28 | 10658 | 10673 | 3199 |
| 561551 | 1688 | 1703 | ATTATAATCTAGATTG | 52 | 10660 | 10675 | 3200 |
| 561552 | 1690 | 1705 | TGATTATAATCTAGAT | 43 | 10662 | 10677 | 3201 |
| 561553 | 1692 | 1707 | ATTGATTATAATCTAG | 53 | 10664 | 10679 | 3202 |
| 561554 | 1694 | 1709 | CTATTGATTATAATCT | 54 | 10666 | 10681 | 3203 |
| 561555 | 1696 | 1711 | ACCTATTGATTATAAT | 44 | 10668 | 10683 | 3204 |
| 561556 | 1698 | 1713 | TCACCTATTGATTATA | 52 | 10670 | 10685 | 3205 |
| 561557 | 1700 | 1715 | GTTCACCTATTGATTA | 50 | 10672 | 10687 | 3206 |
| 561558 | 1702 | 1717 | AAGTTCACCTATTGAT | 58 | 10674 | 10689 | 3207 |
| 561559 | 1704 | 1719 | ATAAGTTCACCTATTG | 66 | 10676 | 10691 | 3208 |
| 561560 | 1706 | 1721 | TAATAAGTTCACCTAT | 38 | 10678 | 10693 | 3209 |
| 561561 | 1708 | 1723 | TTTAATAAGTTCACCT | 50 | 10680 | 10695 | 3210 |
| 561562 | 1710 | 1725 | TATTTAATAAGTTCAC | 32 | 10682 | 10697 | 3211 |
| 561563 | 1712 | 1727 | GTTATTTAATAAGTTC | 47 | 10684 | 10699 | 3212 |
| 561564 | 1761 | 1776 | CATATGATGCCTTTTA | 63 | 10733 | 1074 | 83213 |
| 561565 | 1763 | 1778 | CTCATATGATGCCTTT | 81 | 10735 | 10750 | 175 |
| 561566 | 1765 | 1780 | AGCTCATATGATGCCT | 81 | 10737 | 10752 | 176 |
| 561567 | 1767 | 1782 | TTAGCTCATATGATGC | 84 | 10739 | 10754 | 177 |

TABLE 148-continued

Inhibition of ANGPTL3 mRNA by deoxy, MOE and cEt oligonucleotides targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561568 | 1769 | 1784 | TATTAGCTCATATGAT | 46 | 10741 | 10756 | 3214 |
| 561569 | 1771 | 1786 | GATATTAGCTCATATG | 49 | 10743 | 10758 | 3215 |
| 561570 | 1773 | 1788 | GTGATATTAGCTCATA | 81 | 10745 | 10760 | 3216 |
| 561571 | 1775 | 1790 | TTGTGATATTAGCTCA | 85 | 10747 | 10762 | 178 |
| 561572 | 1777 | 1792 | AGTTGTGATATTAGCT | 68 | 10749 | 10764 | 3217 |
| 561573 | 1779 | 1794 | AAAGTTGTGATATTAG | 45 | 10751 | 10766 | 3218 |
| 561574 | 1781 | 1796 | GGAAAGTTGTGATATT | 27 | 10753 | 10768 | 3219 |
| 561575 | 1783 | 1798 | TGGGAAAGTTGTGATA | 36 | 10755 | 10770 | 3220 |
| 561576 | 1785 | 1800 | ACTGGGAAAGTTGTGA | 83 | 10757 | 10772 | 179 |
| 561577 | 1787 | 1802 | AAACTGGGAAAGTTGT | 56 | 10759 | 10774 | 3221 |
| 561578 | 1789 | 1804 | TTAAACTGGGAAAGTT | 44 | 10761 | 10776 | 3222 |
| 561579 | 1794 | 1809 | GTTTTTAAACTGGGA | 58 | 10766 | 10781 | 3223 |
| 561580 | 1796 | 1811 | TAGTTTTTTAAACTGG | 0 | 10768 | 10783 | 3224 |
| 561581 | 1802 | 1817 | GAGTACTAGTTTTTA | 18 | 10774 | 10789 | 3225 |
| 561582 | 1804 | 1819 | AAGAGTACTAGTTTTT | 55 | 10776 | 10791 | 3226 |
| 561583 | 1806 | 1821 | ACAAGAGTACTAGTTT | 51 | 10778 | 10793 | 3227 |
| 561584 | 1808 | 1823 | TAACAAGAGTACTAGT | 53 | 10780 | 10795 | 3228 |
| 561585 | 1810 | 1825 | TTTAACAAGAGTACTA | 48 | 10782 | 10797 | 3229 |
| 561586 | 1812 | 1827 | GTTTTAACAAGAGTAC | 49 | 10784 | 10799 | 3230 |
| 561587 | 1814 | 1829 | GAGTTTTAACAAGAGT | 54 | 10786 | 10801 | 3231 |
| 561588 | 1816 | 1831 | TAGAGTTTTAACAAGA | 9 | 10788 | 10803 | 3232 |
| 561589 | 1819 | 1834 | GTTTAGAGTTTTAACA | 24 | 10791 | 10806 | 3233 |
| 561590 | 1822 | 1837 | CAAGTTTAGAGTTTTA | 30 | 10794 | 10809 | 3234 |
| 561591 | 1824 | 1839 | GTCAAGTTTAGAGTTT | 60 | 10796 | 10811 | 3235 |
| 561592 | 1826 | 1841 | TAGTCAAGTTTAGAGT | 56 | 10798 | 10813 | 3236 |
| 561593 | 1828 | 1843 | TTTAGTCAAGTTTAGA | 41 | 10800 | 10815 | 3237 |
| 561594 | 1830 | 1845 | TATTTAGTCAAGTTTA | 14 | 10802 | 10817 | 3238 |
| 561595 | 1832 | 1847 | TGTATTTAGTCAAGTT | 39 | 10804 | 10819 | 3239 |
| 561596 | 1834 | 1849 | TCTGTATTTAGTCAAG | 51 | 10806 | 10821 | 3240 |
| 561597 | 1836 | 1851 | CCTCTGTATTTAGTCA | 72 | 10808 | 10823 | 3241 |
| 561598 | 1838 | 1853 | GTCCTCTGTATTTAGT | 55 | 10810 | 10825 | 3242 |
| 561599 | 1840 | 1855 | CAGTCCTCTGTATTTA | 63 | 10812 | 10827 | 3243 |
| 561600 | 1842 | 1857 | ACCAGTCCTCTGTATT | 66 | 10814 | 10829 | 3244 |
| 561601 | 1844 | 1859 | TTACCAGTCCTCTGTA | 57 | 10816 | 10831 | 3245 |
| 561602 | 1846 | 1861 | AATTACCAGTCCTCTG | 43 | 10818 | 10833 | 3246 |
| 561603 | 1848 | 1863 | ACAATTACCAGTCCTC | 67 | 10820 | 10835 | 3247 |

TABLE 149

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 561770 | N/A | N/A | ACAAAGGTAGGTCACC | 77 | 11576 | 11591 | 143 |
| 586719 | N/A | N/A | TCTGACAAGATTCCTT | 76 | 11167 | 11182 | 3248 |
| 586720 | N/A | N/A | ATCTGACAAGATTCCT | 79 | 11168 | 11183 | 3249 |
| 586721 | N/A | N/A | TAATCTGACAAGATTC | 50 | 11170 | 11185 | 3250 |
| 586722 | N/A | N/A | GTAATCTGACAAGATT | 41 | 11171 | 11186 | 3251 |
| 586723 | N/A | N/A | CTTGTCAGGCTGTTTA | 50 | 11312 | 11327 | 3252 |
| 586724 | N/A | N/A | GCTTGTCAGGCTGTTT | 81 | 11313 | 11328 | 3253 |
| 586725 | N/A | N/A | ATGCTTGTCAGGCTGT | 78 | 11315 | 11330 | 3254 |
| 586726 | N/A | N/A | TACATGCTTGTCAGGC | 78 | 11318 | 11333 | 3255 |
| 586727 | N/A | N/A | ATACATGCTTGTCAGG | 76 | 11319 | 11334 | 3256 |
| 586728 | N/A | N/A | AAAGGTAGGTCACCAT | 72 | 11574 | 11589 | 3257 |
| 586729 | N/A | N/A | CAAAGGTAGGTCACCA | 69 | 11575 | 11590 | 3258 |
| 586730 | N/A | N/A | GACAAAGGTAGGTCAC | 55 | 11577 | 11592 | 3259 |
| 586731 | N/A | N/A | TGACAAAGGTAGGTCA | 32 | 11578 | 11593 | 3260 |
| 586732 | N/A | N/A | TCTGACATAGCTTTTT | 63 | 5436 | 5451 | 3261 |
| 586733 | N/A | N/A | ATTCTGACATAGCTTT | 76 | 5438 | 5453 | 3262 |
| 586734 | N/A | N/A | GATTCTGACATAGCTT | 73 | 5439 | 5454 | 3263 |
| 586735 | N/A | N/A | GGATTCTGACATAGCT | 81 | 5440 | 5455 | 3264 |
| 586736 | N/A | N/A | ATGGATTCTGACATAG | 74 | 5442 | 5457 | 3265 |
| 586737 | N/A | N/A | CATGGATTCTGACATA | 72 | 5443 | 5458 | 3266 |

TABLE 149-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586738 | N/A | N/A | ACATGGATTCTGACAT | 59 | 5444 | 5459 | 3267 |
| 586739 | N/A | N/A | TACATGGATTCTGACA | 71 | 5445 | 5460 | 3268 |
| 586740 | N/A | N/A | ATACATGGATTCTGAC | 60 | 5446 | 5461 | 3269 |
| 586741 | N/A | N/A | TTTAGCAGCACTACTA | 65 | 5628 | 5643 | 3270 |
| 586742 | N/A | N/A | TTTTAGCAGCACTACT | 51 | 5629 | 5644 | 3271 |
| 586743 | N/A | N/A | CTTTTAGCAGCACTAC | 74 | 5630 | 5645 | 3272 |
| 586744 | N/A | N/A | CCTTTTAGCAGCACTA | 83 | 5631 | 5646 | 223 |
| 586745 | N/A | N/A | ACCTTTTAGCAGCACT | 84 | 5632 | 5647 | 224 |
| 586746 | N/A | N/A | AAACCTTTTAGCAGCA | 87 | 5634 | 5649 | 225 |
| 586747 | N/A | N/A | AAAACCTTTTAGCAGC | 80 | 5635 | 5650 | 3273 |
| 586748 | N/A | N/A | GATAAAAAACCTTTTA | 16 | 5640 | 5655 | 3274 |
| 586749 | N/A | N/A | TGATAAAAAACCTTTT | 25 | 5641 | 5656 | 3275 |
| 586750 | N/A | N/A | AGATGTTGGCAGGTTG | 72 | 6188 | 6203 | 3276 |
| 586751 | N/A | N/A | TAGATGTTGGCAGGTT | 76 | 6189 | 6204 | 3277 |
| 586752 | N/A | N/A | GTAGATGTTGGCAGGT | 73 | 6190 | 6205 | 3278 |
| 586753 | N/A | N/A | TGTAGATGTTGGCAGG | 65 | 6191 | 6206 | 3279 |
| 586754 | N/A | N/A | CTGTAGATGTTGGCAG | 61 | 6192 | 6207 | 3280 |
| 586755 | N/A | N/A | ATCTGTAGATGTTGGC | 84 | 6194 | 6209 | 226 |
| 586756 | N/A | N/A | TATCTGTAGATGTTGG | 71 | 6195 | 6210 | 3281 |
| 586757 | N/A | N/A | ATATCTGTAGATGTTG | 61 | 6196 | 6211 | 3282 |
| 586758 | N/A | N/A | CATATCTGTAGATGTT | 63 | 6197 | 6212 | 3283 |
| 586759 | N/A | N/A | TTTGAACCAGGCTTTC | 47 | 6243 | 6258 | 3284 |
| 586760 | N/A | N/A | AATTTGAACCAGGCTT | 78 | 6245 | 6260 | 3285 |
| 586761 | N/A | N/A | TAATTTGAACCAGGCT | 83 | 6246 | 6261 | 227 |
| 586762 | N/A | N/A | CATAATTTGAACCAGG | 81 | 6248 | 6263 | 3286 |
| 586763 | N/A | N/A | ACATAATTTGAACCAG | 36 | 6249 | 6264 | 3287 |
| 586764 | N/A | N/A | TACATAATTTGAACCA | 38 | 6250 | 6265 | 3288 |
| 586765 | N/A | N/A | ATACATAATTTGAACC | 15 | 6251 | 6266 | 3289 |
| 586766 | N/A | N/A | ACATTGGTCGGAAAAC | 43 | 6424 | 6439 | 3290 |
| 586767 | N/A | N/A | GACATTGGTCGGAAAA | 49 | 6425 | 6440 | 3291 |
| 586768 | N/A | N/A | AGACATTGGTCGGAAA | 59 | 6426 | 6441 | 3292 |
| 586769 | N/A | N/A | CAGACATTGGTCGGAA | 66 | 6427 | 6442 | 3293 |
| 586770 | N/A | N/A | GCAGACATTGGTCGGA | 80 | 6428 | 6443 | 3294 |
| 586771 | N/A | N/A | AAGCAGACATTGGTCG | 65 | 6430 | 6445 | 3295 |
| 586772 | N/A | N/A | TGTACAGATTACCTGT | 51 | 6506 | 6521 | 3296 |
| 586773 | N/A | N/A | TTGTACAGATTACCTG | 34 | 6507 | 6522 | 3297 |
| 586774 | N/A | N/A | ATTGTACAGATTACCT | 62 | 6508 | 6523 | 3298 |
| 586775 | N/A | N/A | GATTGTACAGATTACC | 59 | 6509 | 6524 | 3299 |
| 586776 | N/A | N/A | AGATTGTACAGATTAC | 46 | 6510 | 6525 | 3300 |
| 586777 | N/A | N/A | TCAGATTGTACAGATT | 63 | 6512 | 6527 | 3301 |
| 586778 | N/A | N/A | TTCAGATTGTACAGAT | 63 | 6513 | 6528 | 3302 |
| 586779 | N/A | N/A | ATTCAGATTGTACAGA | 71 | 6514 | 6529 | 3303 |
| 586780 | N/A | N/A | TATTCAGATTGTACAG | 55 | 6515 | 6530 | 3304 |
| 586781 | N/A | N/A | TTATTCAGATTGTACA | 52 | 6516 | 6531 | 3305 |
| 586782 | N/A | N/A | TAGGTATGTCTTTTAT | 52 | 6936 | 6951 | 3306 |
| 586783 | N/A | N/A | TGTCTTAGGTATGTCT | 76 | 6941 | 6956 | 3307 |
| 586784 | N/A | N/A | ATTGTCTTAGGTATGT | 73 | 6943 | 6958 | 3308 |
| 586785 | N/A | N/A | GATTGTCTTAGGTATG | 60 | 6944 | 6959 | 3309 |
| 586786 | N/A | N/A | TTCTTAGATGGCGTGT | 74 | 7207 | 7222 | 3310 |
| 586787 | N/A | N/A | TTTTCTTAGATGGCGT | 86 | 7209 | 7224 | 228 |
| 586788 | N/A | N/A | ATTTTTCTTAGATGGC | 75 | 7211 | 7226 | 3311 |
| 586789 | N/A | N/A | CATTTTTCTTAGATGG | 49 | 7212 | 7227 | 3312 |
| 586790 | N/A | N/A | GCATTTTTCTTAGATG | 47 | 7213 | 7228 | 3313 |
| 586791 | N/A | N/A | ATAAGTCCCAATTTTA | 27 | 10066 | 10081 | 3314 |
| 586792 | N/A | N/A | TATAAGTCCCAATTTT | 27 | 10067 | 10082 | 3315 |
| 586793 | N/A | N/A | GTATAAGTCCCAATTT | 28 | 10068 | 10083 | 3316 |
| 586794 | N/A | N/A | TGTATAAGTCCCAATT | 38 | 10069 | 10084 | 3317 |
| 586795 | N/A | N/A | CTGTATAAGTCCCAAT | 69 | 10070 | 10085 | 3318 |
| 586796 | N/A | N/A | ATCTGTATAAGTCCCA | 88 | 10072 | 10087 | 229 |
| 586797 | N/A | N/A | AATCTGTATAAGTCCC | 84 | 10073 | 10088 | 230 |
| 586798 | N/A | N/A | TAATCTGTATAAGTCC | 58 | 10074 | 10089 | 3319 |
| 586799 | N/A | N/A | ATAATCTGTATAAGTC | 21 | 10075 | 10090 | 3320 |
| 586800 | N/A | N/A | AATAATCTGTATAAGT | 12 | 10076 | 10091 | 3321 |
| 586801 | N/A | N/A | TGCATGTATCCCAGTT | 80 | 10095 | 10110 | 3322 |
| 586802 | N/A | N/A | ATGCATGTATCCCAGT | 83 | 10096 | 10111 | 231 |
| 586803 | N/A | N/A | AGATGCATGTATCCCA | 79 | 10098 | 10113 | 232 |
| 586804 | N/A | N/A | TAGATGCATGTATCCC | 87 | 10099 | 10114 | 3323 |
| 586805 | N/A | N/A | TTAGATGCATGTATCC | 78 | 10100 | 10115 | 3324 |
| 586806 | N/A | N/A | TTTAGATGCATGTATC | 50 | 10101 | 10116 | 3325 |
| 586653 | 7 | 22 | GTGGAACTGTTTTCTT | 63 | 3111 | 3126 | 3326 |
| 586656 | 9 | 24 | ACGTGGAACTGTTTTC | 72 | 3113 | 3128 | 3327 |
| 586658 | 99 | 114 | TTGATCAATTCTGGAG | 74 | 3203 | 3218 | 3328 |

TABLE 149-continued

Inhibition of ANGPTL3 mRNA by deoxy, MOE and (S)-cEt gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 586660 | 101 | 116 | TCTTGATCAATTCTGG | 71 | 3205 | 3220 | 3329 |
| 561011 | 102 | 117 | GTCTTGATCAATTCTG | 91 | 3206 | 3221 | 114 |
| 586661 | 103 | 118 | TGTCTTGATCAATTCT | 85 | 3207 | 3222 | 209 |
| 586663 | 134 | 149 | GGCTCTGGAGATAGAG | 63 | 3238 | 3253 | 3330 |
| 586665 | 136 | 151 | TTGGCTCTGGAGATAG | 63 | 3240 | 3255 | 3331 |
| 586668 | 140 | 155 | GATTTTGGCTCTGGAG | 64 | 3244 | 3259 | 3332 |
| 586669 | 142 | 157 | TTGATTTTGGCTCTGG | 89 | 3246 | 3261 | 210 |
| 561026 | 143 | 158 | CTTGATTTTGGCTCTG | 84 | 3247 | 3262 | 117 |
| 586670 | 144 | 159 | TCTTGATTTTGGCTCT | 71 | 3248 | 3263 | 3333 |
| 586671 | 146 | 161 | AATCTTGATTTTGGCT | 70 | 3250 | 3265 | 3334 |
| 586672 | 148 | 163 | CAAATCTTGATTTTGG | 81 | 3252 | 3267 | 3335 |
| 586673 | 298 | 313 | GCAGCGATAGATCATA | 76 | 3402 | 3417 | 3336 |
| 586674 | 300 | 315 | TTGCAGCGATAGATCA | 76 | 3404 | 3419 | 3337 |
| 586675 | 304 | 319 | TGGTTTGCAGCGATAG | 82 | 3408 | 3423 | 3338 |
| 586676 | 306 | 321 | ACTGGTTTGCAGCGAT | 89 | 3410 | 3425 | 211 |
| 586677 | 315 | 330 | TTTGATTTCACTGGTT | 62 | 3419 | 3434 | 3339 |
| 586678 | 317 | 332 | TCTTTGATTTCACTGG | 66 | 3421 | 3436 | 3340 |
| 586679 | 342 | 357 | AGTTCTTCTCAGTTCC | 77 | 3446 | 3461 | 3341 |
| 586680 | 476 | 491 | TTAGTTAGTTGCTCTT | 65 | 3580 | 3595 | 3342 |
| 586681 | 478 | 493 | AGTTAGTTAGTTGCTC | 69 | 3582 | 3597 | 3343 |
| 586682 | 703 | 718 | GTGCTCTTGGCTTGGA | 78 | 6716 | 6731 | 3344 |
| 586683 | 705 | 720 | TGGTGCTCTTGGCTTG | 77 | 6718 | 6733 | 3345 |
| 586684 | 802 | 817 | TATGTTCACCTCTGTT | 55 | 7387 | 7402 | 3346 |
| 586685 | 804 | 819 | TGTATGTTCACCTCTG | 79 | 7389 | 7404 | 3347 |
| 586686 | 1260 | 1275 | ACACTCATCATGCCAC | 72 | 10232 | 10247 | 3348 |
| 586687 | 1262 | 1277 | CCACACTCATCATGCC | 82 | 10234 | 10249 | 3349 |
| 586688 | 1308 | 1323 | AGATTTTGCTCTTGGT | 87 | 10280 | 10295 | 212 |
| 586689 | 1310 | 1325 | TTAGATTTTGCTCTTG | 78 | 10282 | 10297 | 3350 |
| 586690 | 1351 | 1366 | CATTTTGAGACTTCCA | 91 | 10323 | 10338 | 213 |
| 586691 | 1353 | 1368 | TCCATTTTGAGACTTC | 86 | 10325 | 10340 | 214 |
| 586692 | 1365 | 1380 | AGAGTATAACCTTCCA | 88 | 10337 | 10352 | 220 |
| 586693 | 1367 | 1382 | ATAGAGTATAACCTTC | 69 | 10339 | 10354 | 3351 |
| 586694 | 1402 | 1417 | AATCTGTTGGATGGAT | 59 | 10374 | 10389 | 3352 |
| 586695 | 1404 | 1419 | TGAATCTGTTGGATGG | 79 | 10376 | 10391 | 3353 |
| 586696 | 1420 | 1435 | TTCATTCAAAGCTTTC | 82 | 10392 | 10407 | 3354 |
| 586697 | 1422 | 1437 | AGTTCATTCAAAGCTT | 73 | 10394 | 10409 | 3355 |
| 561463 | 1423 | 1438 | CAGTTCATTCAAAGCT | 88 | 10395 | 10410 | 127 |
| 586698 | 1424 | 1439 | TCAGTTCATTCAAAGC | 69 | 10396 | 10411 | 3356 |
| 586699 | 1488 | 1503 | GATTATTAGACCACAT | 63 | 10460 | 10475 | 3357 |
| 586700 | 1490 | 1505 | CAGATTATTAGACCAC | 90 | 10462 | 10477 | 221 |
| 561487 | 1491 | 1506 | CCAGATTATTAGACCA | 95 | 10463 | 10478 | 131 |
| 586701 | 1492 | 1507 | ACCAGATTATTAGACC | 85 | 10464 | 10479 | 215 |
| 586702 | 1552 | 1567 | TAGACAGTGACTTTAA | 83 | 10524 | 10539 | 216 |
| 586703 | 1554 | 1569 | AATAGACAGTGACTTT | 70 | 10526 | 10541 | 3358 |
| 586704 | 1605 | 1620 | AGAAATGTAAACGGTA | 76 | 10577 | 10592 | 3359 |
| 586705 | 1607 | 1622 | TGAGAAATGTAAACGG | 83 | 10579 | 10594 | 217 |
| 586706 | 1762 | 1777 | TCATATGATGCCTTTT | 69 | 10734 | 10749 | 3360 |
| 586707 | 1764 | 1779 | GCTCATATGATGCCTT | 84 | 10736 | 10751 | 218 |
| 586708 | 1766 | 1781 | TAGCTCATATGATGCC | 83 | 10738 | 10753 | 222 |
| 561567 | 1767 | 1782 | TTAGCTCATATGATGC | 81 | 10739 | 10754 | 177 |
| 586709 | 1768 | 1783 | ATTAGCTCATATGATG | 40 | 10740 | 10755 | 3361 |
| 586710 | 1774 | 1789 | TGTGATATTAGCTCAT | 73 | 10746 | 10761 | 3362 |
| 586711 | 1776 | 1791 | GTTGTGATATTAGCTC | 80 | 10748 | 10763 | 3363 |
| 586712 | 1905 | 1920 | TACTCTGTGCTGACGA | 81 | 10877 | 10892 | 3364 |
| 586713 | 1907 | 1922 | CATACTCTGTGCTGAC | 81 | 10879 | 10894 | 3365 |
| 586714 | 2052 | 2067 | GTTTAAAGACAGCGAA | 72 | 11024 | 11039 | 3366 |
| 586715 | 2054 | 2069 | TTGTTTAAAGACAGCG | 81 | 11026 | 11041 | 3367 |
| 586716 | 2068 | 2083 | GTAGTCATCTCCATTT | 63 | 11040 | 11055 | 3368 |
| 586717 | 2070 | 2085 | TAGTAGTCATCTCCAT | 74 | 11042 | 11057 | 3369 |
| 561650 | 2071 | 2086 | TTAGTAGTCATCTCCA | 79 | 11043 | 11058 | 142 |
| 586718 | 2072 | 2087 | CTTAGTAGTCATCTCC | 84 | 11044 | 11059 | 219 |

Example 120

Antisense Inhibition of Human ANGPTL3 in Hep3B Cells by Deoxy, MOE and (S)-cEt Gapmers Additional antisense oligonucleotides were designed targeting an ANGPTL3 nucleic acid and were tested for their effects on ANGPTL3 mRNA in vitro. ISIS 337487 and ISIS 233717, which are 5-10-5 MOE gapmers, were also included in the assay as benchmark oligonucleotides. Cultured Hep3B cells at a density of 20,000 cells per well were transfected using electroporation with 4,500 nM antisense oligonucleotide. After a treatment period of approximately 24 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as deoxy, MOE, and (S)-cEt oligonucleotides or 5-10-5 MOE gapmers. The deoxy, MOE and (S)-cEt oligonucleotides are 16 nucleosides in length wherein the nucleoside have either a MOE sugar modification, an (S)-cEt sugar modification, or a deoxy sugar residue. The sugar modifications of each antisense oligonucleotide is described as 'eek-d10-kke', where 'k' indicates an (S)-cEt sugar modification; 'd' indicates deoxyribose; the number indicates the number of deoxyribose sugars residues; and 'e' indicates a MOE modification. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The internucleoside linkages throughout each oligonucleotide are phosphorothioate (P=S) linkages. All cytosine residues throughout each oligonucleotide are 5-methylcytosines. "Start site" indicates the 5'-most nucleoside to which the oligonucleotide is targeted in the human gene sequence. "Stop site" indicates the 3'-most nucleoside to which the oligonucleotide is targeted human gene sequence. Each oligonucleotide listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 150

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561671 | N/A | N/A | TCTTAACTCTATATAT | Deoxy, MOE, and cEt | 12 | 3076 | 3091 | 3370 |
| 561672 | N/A | N/A | CTTCTTAACTCTATAT | Deoxy, MOE, and cEt | 12 | 3078 | 3093 | 3371 |
| 561673 | N/A | N/A | GACTTCTTAACTCTAT | Deoxy, MOE, and cEt | 18 | 3080 | 3095 | 3372 |
| 561674 | N/A | N/A | TAGACTTCTTAACTCT | Deoxy, MOE, and cEt | 20 | 3082 | 3097 | 3373 |
| 561675 | N/A | N/A | CCTAGACTTCTTAACT | Deoxy, MOE, and cEt | 9 | 3084 | 3099 | 3374 |
| 561676 | N/A | N/A | GACCTAGACTTCTTAA | Deoxy, MOE, and cEt | 0 | 3086 | 3101 | 3375 |
| 561677 | N/A | N/A | CAGACCTAGACTTCTT | Deoxy, MOE, and cEt | 18 | 3088 | 3103 | 3376 |
| 561678 | N/A | N/A | AGCAGACCTAGACTTC | Deoxy, MOE, and cEt | 26 | 3090 | 3105 | 3377 |
| 561679 | N/A | N/A | GAAGCAGACCTAGACT | Deoxy, MOE, and cEt | 24 | 3092 | 3107 | 3378 |
| 561680 | N/A | N/A | TGGAAGCAGACCTAGA | Deoxy, MOE, and cEt | 30 | 3094 | 3109 | 3379 |
| 561758 | N/A | N/A | CTTTAACAAATGGGTT | Deoxy, MOE, and cEt | 25 | 11539 | 11554 | 3380 |
| 561759 | N/A | N/A | ATCCTTTAACAAATGG | Deoxy, MOE, and cEt | 31 | 11542 | 11557 | 3381 |
| 561760 | N/A | N/A | CTATATCCTTTAACAA | Deoxy, MOE, and cEt | 28 | 11546 | 11561 | 3382 |
| 561761 | N/A | N/A | GCACTATATCCTTTAA | Deoxy, MOE, and cEt | 59 | 11549 | 11564 | 3383 |
| 561762 | N/A | N/A | TGGGCACTATATCCTT | Deoxy, MOE, and cEt | 34 | 11552 | 11570 | 3385 |
| 561764 | N/A | N/A | ATAACTTGGGCACTAT | Deoxy, MOE, and cEt | 51 | 11558 | 11573 | 3386 |
| 561765 | N/A | N/A | CATATAACTTGGGCAC | Deoxy, MOE, and cEt | 47 | 11156 | 11576 | 3387 |
| 561766 | N/A | N/A | CACCATATAACTTGGG | Deoxy, MOE, and cEt | 47 | 11564 | 11579 | 3388 |
| 561767 | N/A | N/A | GGTCACCATATAACTT | Deoxy, MOE, and cEt | 58 | 11567 | 11582 | 3389 |
| 561768 | N/A | N/A | GTAGGTCACCATATAA | Deoxy, MOE, and cEt | 62 | 11570 | 11585 | 3390 |
| 561769 | N/A | N/A | AAGGTAGGTCACCATA | Deoxy, MOE, and cEt | 65 | 11573 | 11588 | 3391 |
| 561770 | N/A | N/A | ACAAAGGTAGGTCACC | Deoxy, MOE, and cEt | 73 | 11576 | 11591 | 143 |
| 561771 | N/A | N/A | TTGACAAAGGTAGGTC | Deoxy, MOE, and cEt | 70 | 11579 | 11594 | 3392 |
| 561772 | N/A | N/A | GTATTGACAAAGGTAG | Deoxy, MOE, and cEt | 58 | 11582 | 11597 | 3393 |
| 561773 | N/A | N/A | TAAGTATTGACAAAGG | Deoxy, MOE, and cEt | 42 | 11585 | 11600 | 3394 |
| 561774 | N/A | N/A | TGCTAAGTATTGACAA | Deoxy, MOE, and cEt | 51 | 11588 | 11603 | 3395 |
| 561775 | N/A | N/A | TAATGCTAAGTATTGA | Deoxy, MOE, and cEt | 42 | 11159 | 11606 | 3396 |
| 561776 | N/A | N/A | TACATAATGCTAAGTA | Deoxy, MOE, and cEt | 36 | 11595 | 11610 | 3397 |
| 561777 | N/A | N/A | GGATAAATTTGAAATAC | Deoxy, MOE, and cEt | 24 | 11608 | 11623 | 3398 |
| 561778 | N/A | N/A | TATTGGATAATTTGAA | Deoxy, MOE, and cEt | 35 | 11612 | 11627 | 3399 |
| 561779 | N/A | N/A | GTATATTGGATAATTT | Deoxy, MOE, and cEt | 0 | 11615 | 11630 | 3400 |
| 561780 | N/A | N/A | CATGTATATTGGATAA | Deoxy, MOE, and cEt | 20 | 11618 | 11633 | 3401 |
| 561781 | N/A | N/A | TGACATGTATATTGGA | Deoxy, MOE, and cEt | 73 | 11162 | 11636 | 144 |
| 561782 | N/A | N/A | CTTTTATATATGTGAC | Deoxy, MOE, and cEt | 37 | 11652 | 11667 | 3402 |
| 561783 | N/A | N/A | GATCATACATATCTTT | Deoxy, MOE, and cEt | 51 | 11664 | 11679 | 3403 |
| 561784 | N/A | N/A | ATAGATCATACATATC | Deoxy, MOE, and cEt | 46 | 11667 | 11682 | 3404 |
| 561785 | N/A | N/A | CACATAGATCATACAT | Deoxy, MOE, and cEt | 65 | 11670 | 11685 | 3405 |
| 561786 | N/A | N/A | ATTCACATAGATCATA | Deoxy, MOE, and cEt | 48 | 11673 | 11688 | 3406 |
| 561787 | N/A | N/A | AGGATTCACATAGATC | Deoxy, MOE, and cEt | 48 | 11676 | 11691 | 3407 |
| 561788 | N/A | N/A | CTTAGGATTCACATAG | Deoxy, MOE, and cEt | 42 | 11679 | 11694 | 3408 |
| 561789 | N/A | N/A | TTACTTAGGATTCACA | Deoxy, MOE, and cEt | 58 | 11682 | 11697 | 3409 |
| 561790 | N/A | N/A | TATTTACTTAGGATTC | Deoxy, MOE, and cEt | 45 | 11685 | 11700 | 3410 |
| 561791 | N/A | N/A | GTACTTTCTGGAACA | Deoxy, MOE, and cEt | 77 | 11704 | 11719 | 145 |
| 561792 | N/A | N/A | CCTGAAAATTATAGAT | Deoxy, MOE, and cEt | 35 | 11174 | 11756 | 3411 |
| 561793 | N/A | N/A | GGTCCTGAAAATTATA | Deoxy, MOE, and cEt | 32 | 11744 | 11759 | 3412 |
| 561794 | N/A | N/A | TGTGGTCCTGAAAATT | Deoxy, MOE, and cEt | 45 | 11747 | 11762 | 3413 |
| 561795 | N/A | N/A | GTCTGTGGTCCTGAAA | Deoxy, MOE, and cEt | 47 | 11750 | 11765 | 3414 |
| 561796 | N/A | N/A | TTAGTCTGTGGTCCTG | Deoxy, MOE, and cEt | 67 | 11753 | 11768 | 3415 |
| 561797 | N/A | N/A | AGCTTAGTCTGTGGTC | Deoxy, MOE, and cEt | 55 | 11756 | 11771 | 3416 |
| 561798 | N/A | N/A | GACAGCTTAGTCTGTG | Deoxy, MOE, and cEt | 47 | 11759 | 11774 | 3417 |

TABLE 150-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561799 | N/A | N/A | TTCGACAGCTTAGTCT | Deoxy, MOE, and cEt | 68 | 11762 | 11777 | 3418 |
| 561800 | N/A | N/A | AATTTCGACAGCTTAG | Deoxy, MOE, and cEt | 61 | 11765 | 11780 | 3419 |
| 561801 | N/A | N/A | GTTAATTTCGACAGCT | Deoxy, MOE, and cEt | 70 | 11768 | 11783 | 3420 |
| 561802 | N/A | N/A | CCTAAAAAAATCAGCG | Deoxy, MOE, and cEt | 19 | 11783 | 11798 | 3421 |
| 561803 | N/A | N/A | GGCCCTAAAAAAATCA | Deoxy, MOE, and cEt | 0 | 11786 | 11801 | 3422 |
| 561804 | N/A | N/A | TTCTGGCCCTAAAAAA | Deoxy, MOE, and cEt | 10 | 11790 | 11805 | 3423 |
| 561805 | N/A | N/A | GTATTCTGGCCCTAAA | Deoxy, MOE, and cEt | 44 | 11793 | 11808 | 3424 |
| 561806 | N/A | N/A | TTGGTATTCTGGCCCT | Deoxy, MOE, and cEt | 45 | 11796 | 11811 | 3425 |
| 561807 | N/A | N/A | ATTTTGGTATTCTGGC | Deoxy, MOE, and cEt | 59 | 11799 | 11814 | 3426 |
| 561808 | N/A | N/A | GCCATTTTGGTATTCT | Deoxy, MOE, and cEt | 58 | 11802 | 11817 | 3427 |
| 561809 | N/A | N/A | GGAGCCATTTTGGTAT | Deoxy, MOE, and cEt | 33 | 11805 | 11820 | 3428 |
| 561810 | N/A | N/A | AGAGGAGCCATTTTGG | Deoxy, MOE, and cEt | 36 | 11808 | 11823 | 3429 |
| 561811 | N/A | N/A | AAGAGAGGAGCCATTT | Deoxy, MOE, and cEt | 14 | 11811 | 11826 | 3430 |
| 561812 | N/A | N/A | ATTGTCCAATTTTGGG | Deoxy, MOE, and cEt | 25 | 11829 | 11844 | 3431 |
| 561813 | N/A | N/A | GAAATTGTCCAATTTT | Deoxy, MOE, and cEt | 38 | 11832 | 11847 | 3432 |
| 561814 | N/A | N/A | TTTGAAATTGTCCAAT | Deoxy, MOE, and cEt | 36 | 11835 | 11850 | 3433 |
| 561815 | N/A | N/A | GCATTTGAAATTGTCC | Deoxy, MOE, and cEt | 67 | 11838 | 11853 | 3434 |
| 561816 | N/A | N/A | GCAACTCATATATTAA | Deoxy, MOE, and cEt | 57 | 11869 | 11884 | 3435 |
| 561817 | N/A | N/A | GAAGCAACTCATATAT | Deoxy, MOE, and cEt | 46 | 11872 | 11887 | 3436 |
| 561818 | N/A | N/A | GAGGAAGCAACTCATA | Deoxy, MOE, and cEt | 14 | 11875 | 11890 | 3437 |
| 561819 | N/A | N/A | ATAGAGGAAGCAACTC | Deoxy, MOE, and cEt | 60 | 11878 | 11893 | 3438 |
| 561820 | N/A | N/A | CAAATAGAGGAAGCAA | Deoxy, MOE, and cEt | 36 | 11188 | 11896 | 3439 |
| 561821 | N/A | N/A | AACCAAATAGAGGAAG | Deoxy, MOE, and cEt | 38 | 11884 | 11899 | 3440 |
| 561822 | N/A | N/A | GGAAACCAAATAGAGG | Deoxy, MOE, and cEt | 51 | 11887 | 11902 | 3441 |
| 561823 | N/A | N/A | CTTTAAGTGAAGTTAC | Deoxy, MOE, and cEt | 30 | 3636 | 3651 | 3442 |
| 561824 | N/A | N/A | TACTTACTTTAAGTGA | Deoxy, MOE, and cEt | 27 | 3642 | 3657 | 3443 |
| 561825 | N/A | N/A | GAACCCTCTTTATTTT | Deoxy, MOE, and cEt | 25 | 3659 | 3674 | 3444 |
| 561826 | N/A | N/A | AAACATGAACCCTCTT | Deoxy, MOE, and cEt | 14 | 3665 | 3680 | 3445 |
| 561827 | N/A | N/A | GATCCACATTGAAAAC | Deoxy, MOE, and cEt | 0 | 3683 | 3698 | 3446 |
| 561828 | N/A | N/A | CATGCCTTAGAAATAT | Deoxy, MOE, and cEt | 33 | 3710 | 3725 | 3447 |
| 561829 | N/A | N/A | AAATGGCATGCCTTAG | Deoxy, MOE, and cEt | 46 | 3716 | 3731 | 3448 |
| 561830 | N/A | N/A | GTATTTCAAATGGCAT | Deoxy, MOE, and cEt | 54 | 3723 | 3738 | 3449 |
| 561831 | N/A | N/A | GCAACAAAGTATTTCA | Deoxy, MOE, and cEt | 60 | 3731 | 3746 | 3450 |
| 561832 | N/A | N/A | GTATTTCAACAATGCA | Deoxy, MOE, and cEt | 28 | 3744 | 3759 | 3451 |
| 561833 | N/A | N/A | ATAACATTAGGGAAAC | Deoxy, MOE, and cEt | 18 | 3827 | 3842 | 3452 |
| 561834 | N/A | N/A | TCATATATAACATTAG | Deoxy, MOE, and cEt | 18 | 3833 | 3848 | 3453 |
| 561912 | N/A | N/A | GTGGTTTTGAGCAAAG | Deoxy, MOE, and cEt | 5 | 4736 | 4751 | 3454 |
| 561913 | N/A | N/A | CTATTGTGTGGTTTTG | Deoxy, MOE, and cEt | 36 | 4743 | 4758 | 3455 |
| 561914 | N/A | N/A | GGAAAGCTATTGTGTG | Deoxy, MOE, and cEt | 18 | 4749 | 4764 | 3456 |
| 561915 | N/A | N/A | TATGAGTGAAATGGAA | Deoxy, MOE, and cEt | 13 | 4761 | 4776 | 3457 |
| 561916 | N/A | N/A | AGCCAATATGAGTGAA | Deoxy, MOE, and cEt | 57 | 4767 | 4782 | 3458 |
| 561917 | N/A | N/A | CTAAAGAGCCAATATG | Deoxy, MOE, and cEt | 33 | 4773 | 4788 | 3459 |
| 561918 | N/A | N/A | CTTGGTCTAAAGAGCC | Deoxy, MOE, and cEt | 70 | 4779 | 4794 | 146 |
| 561919 | N/A | N/A | GGTAATCTTGGTCTAA | Deoxy, MOE, and cEt | 46 | 4785 | 4800 | 3460 |
| 561920 | N/A | N/A | GATGACGAAGGGTTGG | Deoxy, MOE, and cEt | 28 | 4800 | 4815 | 3461 |
| 561921 | N/A | N/A | CAGTGAGATGACGAAG | Deoxy, MOE, and cEt | 39 | 4806 | 4821 | 3462 |
| 561922 | N/A | N/A | TGAAGTCAGTGAGATG | Deoxy, MOE, and cEt | 49 | 4812 | 4827 | 3463 |
| 561923 | N/A | N/A | AGGAGGTGAAGTCAGT | Deoxy, MOE, and cEt | 35 | 4818 | 4833 | 3464 |
| 561924 | N/A | N/A | GAGTAGAGGAGGTGAA | Deoxy, MOE, and cEt | 33 | 4824 | 4839 | 3465 |
| 561925 | N/A | N/A | TAACTAGAGTAGAGGA | Deoxy, MOE, and cEt | 35 | 4830 | 4845 | 3466 |
| 561926 | N/A | N/A | TCAGAATAACTAGAGT | Deoxy, MOE, and cEt | 24 | 4836 | 4851 | 3467 |
| 561927 | N/A | N/A | AAGCGGTCAGAATAAC | Deoxy, MOE, and cEt | 39 | 4842 | 4857 | 3468 |
| 561928 | N/A | N/A | CTGGTAAAGCGGTCAG | Deoxy, MOE, and cEt | 51 | 4848 | 4863 | 3469 |
| 561929 | N/A | N/A | TGAATACTGGTAAAGC | Deoxy, MOE, and cEt | 63 | 4854 | 4869 | 3470 |
| 561930 | N/A | N/A | TGTGTTTGAATACTGG | Deoxy, MOE, and cEt | 65 | 4860 | 4875 | 3471 |
| 561931 | N/A | N/A | GTTTGATGTGTTTGAA | Deoxy, MOE, and cEt | 49 | 4866 | 4881 | 3472 |
| 561932 | N/A | N/A | CAGTATGTTTGATGTG | Deoxy, MOE, and cEt | 48 | 4872 | 4887 | 3473 |
| 561933 | N/A | N/A | AGGTGGCAGTATGTTT | Deoxy, MOE, and cEt | 0 | 4878 | 4893 | 3474 |
| 561934 | N/A | N/A | GCTTGAGGTGGCAGT | Deoxy, MOE, and cEt | 48 | 4884 | 4899 | 3475 |
| 561935 | N/A | N/A | GGGCAAAGGCTTTGAG | Deoxy, MOE, and cEt | 28 | 4892 | 4907 | 3476 |
| 561936 | N/A | N/A | CAACAAGGGCAAAGGC | Deoxy, MOE, and cEt | 65 | 4898 | 4913 | 3477 |
| 561937 | N/A | N/A | GAGGAAACAACAAGGG | Deoxy, MOE, and cEt | 42 | 4905 | 4920 | 3478 |
| 561938 | N/A | N/A | CCAGTTAGAGGAAACA | Deoxy, MOE, and cEt | 52 | 4912 | 4927 | 3479 |
| 561939 | N/A | N/A | CCAGGGCAGAAGAGCG | Deoxy, MOE, and cEt | 61 | 4930 | 4945 | 3480 |
| 561940 | N/A | N/A | TAGATACCAGGGCAGA | Deoxy, MOE, and cEt | 68 | 4936 | 4951 | 3481 |
| 561941 | N/A | N/A | CAGAGAGTGGGCCACG | Deoxy, MOE, and cEt | 46 | 4952 | 4967 | 3482 |
| 561942 | N/A | N/A | GGAAATCAGAGAGTGG | Deoxy, MOE, and cEt | 42 | 4958 | 4973 | 3483 |
| 561943 | N/A | N/A | CCTAAGGGAAATCAGA | Deoxy, MOE, and cEt | 26 | 4964 | 4979 | 3484 |
| 561944 | N/A | N/A | AACGACCCTAAGGGAA | Deoxy, MOE, and cEt | 45 | 4970 | 4985 | 3485 |
| 561945 | N/A | N/A | TTTGATAACGACCCTA | Deoxy, MOE, and cEt | 57 | 4976 | 4991 | 3486 |
| 561946 | N/A | N/A | TTTTTGTTTGATAACG | Deoxy, MOE, and cEt | 21 | 4982 | 4997 | 3487 |
| 561947 | N/A | N/A | CATTGGGAATTTTTTG | Deoxy, MOE, and cEt | 35 | 4992 | 5007 | 3488 |
| 561948 | N/A | N/A | AGTCTTCATTGGGAAT | Deoxy, MOE, and cEt | 69 | 4998 | 5013 | 3489 |

TABLE 150-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561949 | N/A | N/A | CTTGTAAGTCTTCATT | Deoxy, MOE, and cEt | 35 | 5004 | 5019 | 3490 |
| 561950 | N/A | N/A | AGTGACCTTGTAAGTC | Deoxy, MOE, and cEt | 56 | 5010 | 5025 | 3491 |
| 561951 | N/A | N/A | TGGTTAAGTGACCTTG | Deoxy, MOE, and cEt | 67 | 5016 | 5031 | 3492 |
| 561952 | N/A | N/A | GATTTTTGGTTAAGTG | Deoxy, MOE, and cEt | 43 | 5022 | 5037 | 3493 |
| 561953 | N/A | N/A | GGTTGTGATTTTTGGT | Deoxy, MOE, and cEt | 58 | 5028 | 5043 | 3494 |
| 561954 | N/A | N/A | CCAGGCGGTTGTGATT | Deoxy, MOE, and cEt | 49 | 5034 | 5049 | 3495 |
| 561955 | N/A | N/A | ATGGGACCAGGCGGTT | Deoxy, MOE, and cEt | 52 | 5040 | 5055 | 3496 |
| 561956 | N/A | N/A | AAGTTTTCAGGGATGG | Deoxy, MOE, and cEt | 49 | 5052 | 5067 | 3497 |
| 561957 | N/A | N/A | AAGTAGAAGTTTTCAG | Deoxy, MOE, and cEt | 16 | 5058 | 5073 | 3498 |
| 561958 | N/A | N/A | CTAAGGAAGTAGAAGT | Deoxy, MOE, and cEt | 33 | 5064 | 5079 | 3499 |
| 561959 | N/A | N/A | AAGTAGCTAAGGAAGT | Deoxy, MOE, and cEt | 35 | 5070 | 5085 | 3500 |
| 561960 | N/A | N/A | GGAGAAAAGTAGCTAA | Deoxy, MOE, and cEt | 36 | 5076 | 5091 | 3501 |
| 561961 | N/A | N/A | TGTGCAGGAGAAAAGT | Deoxy, MOE, and cEt | 53 | 5082 | 5097 | 3502 |
| 561962 | N/A | N/A | GGTGAGTGTGCAGGAG | Deoxy, MOE, and cEt | 44 | 5088 | 5103 | 3503 |
| 561963 | N/A | N/A | AATAAAGGTGAGTGTG | Deoxy, MOE, and cEt | 38 | 5094 | 5109 | 3504 |
| 561964 | N/A | N/A | TGCAGGAATAGAAGAG | Deoxy, MOE, and cEt | 58 | 5138 | 5153 | 3505 |
| 561965 | N/A | N/A | TTTTAGTGCAGGAATA | Deoxy, MOE, and cEt | 20 | 5144 | 5159 | 3506 |
| 561966 | N/A | N/A | TATTCACAGAGCTTAC | Deoxy, MOE, and cEt | 63 | 5161 | 5176 | 3507 |
| 561967 | N/A | N/A | TCCCTGTATTCACAGA | Deoxy, MOE, and cEt | 61 | 5167 | 5182 | 3508 |
| 561968 | N/A | N/A | GAAAAAATCCCTGTAT | Deoxy, MOE, and cEt | 22 | 5174 | 5189 | 3509 |
| 561969 | N/A | N/A | TATGAAGATAATGGAA | Deoxy, MOE, and cEt | 34 | 5187 | 5202 | 3510 |
| 561970 | N/A | N/A | GGAGTATATACAAATA | Deoxy, MOE, and cEt | 46 | 5211 | 5226 | 3511 |
| 561971 | N/A | N/A | TATTCTGGAGTATATA | Deoxy, MOE, and cEt | 29 | 5217 | 5232 | 3512 |
| 561972 | N/A | N/A | ATTCTATATTCTGGAG | Deoxy, MOE, and cEt | 58 | 5223 | 5238 | 3513 |
| 561973 | N/A | N/A | CATACAGTATTCTATA | Deoxy, MOE, and cEt | 39 | 5231 | 5246 | 3514 |
| 561974 | N/A | N/A | GTGTGCCATACAGTAT | Deoxy, MOE, and cEt | 48 | 5237 | 5252 | 3515 |
| 561975 | N/A | N/A | AGAAATGCCTACTGTG | Deoxy, MOE, and cEt | 34 | 5250 | 5265 | 3516 |
| 561976 | N/A | N/A | ATTCAACAGAAATGCC | Deoxy, MOE, and cEt | 52 | 5257 | 5272 | 3517 |
| 561977 | N/A | N/A | GAATATGACATTACAT | Deoxy, MOE, and cEt | 33 | 5279 | 5294 | 3518 |
| 561978 | N/A | N/A | CTGTGTGAATATGACA | Deoxy, MOE, and cEt | 63 | 5285 | 5300 | 3519 |
| 561979 | N/A | N/A | ACGCTTCTGTGTGAAT | Deoxy, MOE, and cEt | 59 | 5291 | 5306 | 3520 |
| 561980 | N/A | N/A | TAGCACACGCTTCTGT | Deoxy, MOE, and cEt | 29 | 5297 | 5312 | 3521 |
| 561981 | N/A | N/A | TAATCATAGCACACGC | Deoxy, MOE, and cEt | 64 | 5303 | 5318 | 3522 |
| 561982 | N/A | N/A | CCAAGTAATAATAATC | Deoxy, MOE, and cEt | 26 | 5314 | 5329 | 3523 |
| 561983 | N/A | N/A | AGTAATCCAAGTAATA | Deoxy, MOE, and cEt | 33 | 5320 | 5335 | 3524 |
| 561984 | N/A | N/A | ATTTCTAGTAATCCAA | Deoxy, MOE, and cEt | 42 | 5326 | 5341 | 3525 |
| 561985 | N/A | N/A | CACACTATTTCTAGTA | Deoxy, MOE, and cEt | 40 | 5332 | 5347 | 3526 |
| 561986 | N/A | N/A | ATGAGGCACACTATTT | Deoxy, MOE, and cEt | 47 | 5338 | 5353 | 3527 |
| 561987 | N/A | N/A | TTAATTATGAGGCACA | Deoxy, MOE, and cEt | 58 | 5344 | 5359 | 3528 |
| 561988 | N/A | N/A | TGACCTTTAATTATGA | Deoxy, MOE, and cEt | 38 | 5350 | 5365 | 3529 |
| 562066 | N/A | N/A | GCAATTTATTGAATGA | Deoxy, MOE, and cEt | 27 | 6083 | 6098 | 3530 |
| 562067 | N/A | N/A | GGGTTTGCAATTTATT | Deoxy, MOE, and cEt | 38 | 6089 | 6104 | 3531 |
| 562068 | N/A | N/A | TGTGTTGGGTTTGCAA | Deoxy, MOE, and cEt | 43 | 6095 | 6110 | 3532 |
| 562069 | N/A | N/A | TTTAAGTGTGTTGGGT | Deoxy, MOE, and cEt | 71 | 6101 | 6116 | 3533 |
| 562070 | N/A | N/A | GTTTAGCAGTAACATT | Deoxy, MOE, and cEt | 38 | 6126 | 6141 | 3534 |
| 562071 | N/A | N/A | ATTCAGTAGTTTATCG | Deoxy, MOE, and cEt | 17 | 6145 | 6160 | 3535 |
| 562072 | N/A | N/A | CTATATATTCAGTAGT | Deoxy, MOE, and cEt | 0 | 6151 | 6166 | 3536 |
| 562073 | N/A | N/A | GCTTACTTTCTATATA | Deoxy, MOE, and cEt | 21 | 6160 | 6175 | 3537 |
| 562074 | N/A | N/A | AGTTTGTTTGCTTACT | Deoxy, MOE, and cEt | 63 | 6169 | 6184 | 3538 |
| 562075 | N/A | N/A | TTGGCAAGTTTGTTTG | Deoxy, MOE, and cEt | 55 | 6175 | 6190 | 3539 |
| 562076 | N/A | N/A | GGCAGGTTGGCAAGTT | Deoxy, MOE, and cEt | 68 | 6181 | 6196 | 3540 |
| 562077 | N/A | N/A | GATGTTGGCAGGTTGG | Deoxy, MOE, and cEt | 54 | 6187 | 6202 | 3541 |
| 562078 | N/A | N/A | TCTGTAGATGTTGGCA | Deoxy, MOE, and cEt | 81 | 6193 | 6208 | 147 |
| 562079 | N/A | N/A | AACATATCTGTAGATG | Deoxy, MOE, and cEt | 32 | 6199 | 6214 | 3542 |
| 562080 | N/A | N/A | CCTGTAAACATATCTG | Deoxy, MOE, and cEt | 51 | 6205 | 6220 | 3543 |
| 562081 | N/A | N/A | TTTTGACCTGTAAACA | Deoxy, MOE, and cEt | 14 | 6211 | 6226 | 3544 |
| 562082 | N/A | N/A | GATAATTTTTGACCTG | Deoxy, MOE, and cEt | 49 | 6217 | 6232 | 3545 |
| 562083 | N/A | N/A | TCTTGATAATTTGATA | Deoxy, MOE, and cEt | 13 | 6229 | 6244 | 3546 |
| 562084 | N/A | N/A | AGGCTTTCTTGATAAT | Deoxy, MOE, and cEt | 55 | 6235 | 6250 | 3547 |
| 562085 | N/A | N/A | TGAACCAGGCTTTCTT | Deoxy, MOE, and cEt | 74 | 6241 | 6256 | 3548 |
| 562086 | N/A | N/A | ATAATTTGAACCAGGC | Deoxy, MOE, and cEt | 82 | 6247 | 6262 | 148 |
| 562087 | N/A | N/A | GATAAAGACATAATAC | Deoxy, MOE, and cEt | 21 | 6263 | 6278 | 3549 |
| 562088 | N/A | N/A | ACCTGTGATAAAGACA | Deoxy, MOE, and cEt | 27 | 6269 | 6284 | 3550 |
| 562089 | N/A | N/A | CTTCAGACCTGTGATA | Deoxy, MOE, and cEt | 23 | 6275 | 6290 | 3551 |
| 562090 | N/A | N/A | ACTGATCTTCAGACCT | Deoxy, MOE, and cEt | 48 | 6281 | 6296 | 3552 |
| 562091 | N/A | N/A | GGTCTTACTGATCTTC | Deoxy, MOE, and cEt | 59 | 6287 | 6302 | 3553 |
| 562092 | N/A | N/A | GTTTAGGTCTTACTG | Deoxy, MOE, and cEt | 21 | 6293 | 6308 | 3554 |
| 562093 | N/A | N/A | GTTCAGATTTTAAGTT | Deoxy, MOE, and cEt | 31 | 6321 | 6336 | 3555 |
| 562094 | N/A | N/A | ATATTCTGTTCAGATT | Deoxy, MOE, and cEt | 36 | 6328 | 6343 | 3556 |
| 562095 | N/A | N/A | ATATTGTAATGTATTC | Deoxy, MOE, and cEt | 52 | 6372 | 6387 | 3557 |
| 562096 | N/A | N/A | CTTAGAATATTGTAAT | Deoxy, MOE, and cEt | 13 | 6378 | 6393 | 3558 |
| 562097 | N/A | N/A | GCTTTGCTTAGAATAT | Deoxy, MOE, and cEt | 47 | 6384 | 6399 | 3559 |
| 562098 | N/A | N/A | GAGACTGCTTTGCTTA | Deoxy, MOE, and cEt | 48 | 6390 | 6405 | 3560 |

TABLE 150-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562099 | N/A | N/A | AAAGTAGAGACTGCTT | Deoxy, MOE, and cEt | 44 | 6396 | 6411 | 3561 |
| 562100 | N/A | N/A | AGGCCAAAAGTAGAGA | Deoxy, MOE, and cEt | 59 | 6402 | 6417 | 3562 |
| 562101 | N/A | N/A | TCGGAAAACAGAGCAA | Deoxy, MOE, and cEt | 63 | 6417 | 6432 | 3563 |
| 562102 | N/A | N/A | CATTGGTCGGAAAACA | Deoxy, MOE, and cEt | 53 | 6423 | 6438 | 3564 |
| 562103 | N/A | N/A | AGCAGACATTGGTCGG | Deoxy, MOE, and cEt | 83 | 6429 | 6444 | 149 |
| 562104 | N/A | N/A | AGCAAGGCAAAAAAGC | Deoxy, MOE, and cEt | 22 | 6442 | 6457 | 3565 |
| 562105 | N/A | N/A | GACATTATTTAATAAG | Deoxy, MOE, and cEt | 21 | 6470 | 6485 | 3566 |
| 562106 | N/A | N/A | ATCAGGGACATTATTT | Deoxy, MOE, and cEt | 34 | 6476 | 6491 | 3567 |
| 562107 | N/A | N/A | TATTTAATCAGGGACA | Deoxy, MOE, and cEt | 47 | 6482 | 6497 | 3568 |
| 562108 | N/A | N/A | ATTACCTGTTCTCAAA | Deoxy, MOE, and cEt | 30 | 6499 | 6514 | 3569 |
| 562109 | N/A | N/A | GTACAGATTACCTGTT | Deoxy, MOE, and cEt | 38 | 6505 | 6520 | 3570 |
| 562110 | N/A | N/A | CAGATTGTACAGATTA | Deoxy, MOE, and cEt | 76 | 6511 | 6526 | 150 |
| 562111 | N/A | N/A | GTTATTCAGATTGTAC | Deoxy, MOE, and cEt | 32 | 6517 | 6532 | 3571 |
| 562112 | N/A | N/A | AACAGTGTTATTCAGA | Deoxy, MOE, and cEt | 58 | 6523 | 6538 | 3572 |
| 562113 | N/A | N/A | TAGATAAACAGTGTTA | Deoxy, MOE, and cEt | 33 | 6529 | 6544 | 3573 |
| 562114 | N/A | N/A | TGATATTTAGATAAAC | Deoxy, MOE, and cEt | 26 | 6536 | 6551 | 3574 |
| 562115 | N/A | N/A | GGTGTTTGATATTTAG | Deoxy, MOE, and cEt | 60 | 6542 | 6557 | 3575 |
| 562116 | N/A | N/A | TATAACGGTGTTTGAT | Deoxy, MOE, and cEt | 42 | 6548 | 6563 | 3576 |
| 562117 | N/A | N/A | TAATGTTATAACGGTG | Deoxy, MOE, and cEt | 62 | 6554 | 6569 | 3577 |
| 562118 | N/A | N/A | AGTTCATAATGTTATA | Deoxy, MOE, and cEt | 21 | 6560 | 6575 | 3578 |
| 562119 | N/A | N/A | GTCTTTCAGTTCATAA | Deoxy, MOE, and cEt | 57 | 6567 | 6582 | 3579 |
| 562120 | N/A | N/A | ACAGTTTGTCTTTCAG | Deoxy, MOE, and cEt | 59 | 6574 | 6589 | 3580 |
| 562121 | N/A | N/A | AGAAGTACAGTTTGTC | Deoxy, MOE, and cEt | 3 | 6580 | 6595 | 3581 |
| 562122 | N/A | N/A | GATGTCAGAAGTACAG | Deoxy, MOE, and cEt | 45 | 6586 | 6601 | 3582 |
| 562123 | N/A | N/A | AGTAAGGATGTCAGAA | Deoxy, MOE, and cEt | 44 | 6592 | 6607 | 3583 |
| 562124 | N/A | N/A | AATCTGAGTAAGGATG | Deoxy, MOE, and cEt | 45 | 6598 | 6613 | 3584 |
| 562125 | N/A | N/A | GAATATACAATTAGGG | Deoxy, MOE, and cEt | 13 | 6616 | 6631 | 3585 |
| 562126 | N/A | N/A | TGATACTGAATATACA | Deoxy, MOE, and cEt | 13 | 6623 | 6638 | 3586 |
| 562127 | N/A | N/A | CTGAGCTGATAAAAGA | Deoxy, MOE, and cEt | 1 | 6660 | 6675 | 3587 |
| 562128 | N/A | N/A | ACCATCATGTTTTACA | Deoxy, MOE, and cEt | 44 | 6772 | 6787 | 3588 |
| 562129 | N/A | N/A | TGTCTTACCATCATGT | Deoxy, MOE, and cEt | 29 | 6778 | 6793 | 3589 |
| 562130 | N/A | N/A | CCAAAGTGTCTTACCA | Deoxy, MOE, and cEt | 42 | 6784 | 6799 | 3590 |
| 562131 | N/A | N/A | AACCCACCAAAGTGTC | Deoxy, MOE, and cEt | 33 | 6790 | 6805 | 3591 |
| 562132 | N/A | N/A | GAAGGAAACCCACCAA | Deoxy, MOE, and cEt | 24 | 6796 | 6811 | 3592 |
| 562133 | N/A | N/A | CTTCAAGAAGGAAACC | Deoxy, MOE, and cEt | 28 | 6802 | 6817 | 3593 |
| 562134 | N/A | N/A | TAATAGCTTCAAGAAG | Deoxy, MOE, and cEt | 1 | 6808 | 6823 | 3594 |
| 562135 | N/A | N/A | GGGAATTTGATAATAA | Deoxy, MOE, and cEt | 0 | 6821 | 6836 | 3595 |
| 562136 | N/A | N/A | AGAATAGGGAATTTGA | Deoxy, MOE, and cEt | 18 | 6827 | 6842 | 3596 |
| 562137 | N/A | N/A | GTCCTAAGAATAGGGA | Deoxy, MOE, and cEt | 9 | 6833 | 6848 | 3597 |
| 562138 | N/A | N/A | GAACAAGTCCTAAGAA | Deoxy, MOE, and cEt | 7 | 6839 | 6854 | 3598 |
| 562139 | N/A | N/A | AGTCTAGAACAAGTCC | Deoxy, MOE, and cEt | 70 | 6845 | 6860 | 3599 |
| 562140 | N/A | N/A | TCTTTTAGTCTAGAAC | Deoxy, MOE, and cEt | 22 | 6851 | 6866 | 3600 |
| 562141 | N/A | N/A | TAACTATCTTTTAGTC | Deoxy, MOE, and cEt | 15 | 6857 | 6872 | 3601 |
| 562142 | N/A | N/A | ATCTCTTAACTATCTT | Deoxy, MOE, and cEt | 35 | 6863 | 6878 | 3602 |
| 560991 | 3 | 18 | AACTGTTTTCTTCTGG | Deoxy, MOE, and cEt | 37 | 3107 | 3122 | 3603 |
| 560992 | 8 | 23 | CGTGGAACTGTTTTCT | Deoxy, MOE, and cEt | 74 | 3112 | 3127 | 112 |
| 560993 | 22 | 37 | TCAATTTCAAGCAACG | Deoxy, MOE, and cEt | 68 | 3126 | 3141 | 3604 |
| 560994 | 51 | 66 | CTTAATTGTGAACATT | Deoxy, MOE, and cEt | 21 | 3155 | 3170 | 3605 |
| 560995 | 53 | 68 | AGCTTAATTGTGAACA | Deoxy, MOE, and cEt | 59 | 3157 | 3172 | 3606 |
| 560996 | 55 | 70 | GGAGCTTAATTGTGAA | Deoxy, MOE, and cEt | 0 | 3159 | 3174 | 3607 |
| 560997 | 57 | 72 | AAGGAGCTTAATTGTG | Deoxy, MOE, and cEt | 36 | 3161 | 3176 | 3608 |
| 560998 | 59 | 74 | AGAAGGAGCTTAATTG | Deoxy, MOE, and cEt | 47 | 3163 | 3178 | 3609 |
| 560999 | 61 | 76 | AAAGAAGGAGCTTAAT | Deoxy, MOE, and cEt | 20 | 3165 | 3180 | 3610 |
| 561000 | 76 | 91 | CTAGAGGAACAATAAA | Deoxy, MOE, and cEt | 23 | 3180 | 3195 | 3611 |
| 561001 | 79 | 94 | TAACTAGAGGAACAAT | Deoxy, MOE, and cEt | 19 | 3183 | 3198 | 3612 |
| 561002 | 81 | 96 | AATAACTAGAGGAACA | Deoxy, MOE, and cEt | 38 | 3185 | 3200 | 3613 |
| 561003 | 84 | 99 | GGAAATAACTAGAGGA | Deoxy, MOE, and cEt | 48 | 3188 | 3203 | 3614 |
| 561004 | 86 | 101 | GAGGAAATAACTAGAG | Deoxy, MOE, and cEt | 37 | 3190 | 3205 | 3615 |
| 561005 | 88 | 103 | TGGAGGAAATAACTAG | Deoxy, MOE, and cEt | 68 | 3192 | 3207 | 3616 |
| 561006 | 90 | 105 | TCTGGAGGAAATAACT | Deoxy, MOE, and cEt | 49 | 3194 | 3209 | 3617 |
| 561007 | 94 | 109 | CAATTCTGGAGGAAAT | Deoxy, MOE, and cEt | 43 | 3198 | 3213 | 3618 |
| 561008 | 96 | 111 | ATCAATTCTGGAGGAA | Deoxy, MOE, and cEt | 73 | 3200 | 3215 | 3619 |
| 561009 | 98 | 113 | TGATCAATTCTGGAGG | Deoxy, MOE, and cEt | 72 | 3202 | 3217 | 3620 |
| 561010 | 100 | 115 | CTTGATCAATTCTGGA | Deoxy, MOE, and cEt | 82 | 3204 | 3219 | 113 |
| 561011 | 102 | 117 | GTCTTGATCAATTCTG | Deoxy, MOE, and cEt | 85 | 3206 | 3221 | 114 |
| 561012 | 104 | 119 | TTGTCTTGATCAATTC | Deoxy, MOE, and cEt | 64 | 3208 | 3223 | 3621 |
| 561013 | 106 | 121 | AATTGTCTTGATCAAT | Deoxy, MOE, and cEt | 21 | 3210 | 3225 | 3622 |
| 561014 | 108 | 123 | TGAATTGTCTTGATCA | Deoxy, MOE, and cEt | 66 | 3212 | 3227 | 3623 |
| 561015 | 110 | 125 | GATGAATTGTCTTGAT | Deoxy, MOE, and cEt | 51 | 3214 | 3229 | 3624 |
| 561016 | 112 | 127 | ATGATGAATTGTCTTG | Deoxy, MOE, and cEt | 71 | 3216 | 3231 | 3625 |
| 561017 | 115 | 130 | CAAATGATGAATTGTC | Deoxy, MOE, and cEt | 36 | 3219 | 3234 | 3626 |
| 561018 | 117 | 132 | ATCAAATGATGAATTG | Deoxy, MOE, and cEt | 27 | 3221 | 3236 | 3627 |
| 561019 | 125 | 140 | GATAGAGAATCAAATG | Deoxy, MOE, and cEt | 11 | 3229 | 3244 | 3628 |

TABLE 150-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561020 | 129 | 144 | TGGAGATAGAGAATCA | Deoxy, MOE, and cEt | 73 | 3233 | 3248 | 3629 |
| 561021 | 131 | 146 | TCTGGAGATAGAGAAT | Deoxy, MOE, and cEt | 51 | 3235 | 3250 | 3630 |
| 561022 | 135 | 150 | TGGCTCTGGAGATAGA | Deoxy, MOE, and cEt | 76 | 3239 | 3254 | 115 |
| 561023 | 137 | 152 | TTTGGCTCTGGAGATA | Deoxy, MOE, and cEt | 73 | 3241 | 3256 | 3631 |
| 561024 | 139 | 154 | ATTTTGGCTCTGGAGA | Deoxy, MOE, and cEt | 61 | 3243 | 3258 | 3632 |
| 561025 | 141 | 156 | TGATTTTGGCTCTGGA | Deoxy, MOE, and cEt | 83 | 3245 | 3260 | 116 |
| 561026 | 143 | 158 | CTTGATTTTGGCTCTG | Deoxy, MOE, and cEt | 83 | 3247 | 3262 | 117 |
| 561027 | 145 | 160 | ATCTTGATTTTGGCTC | Deoxy, MOE, and cEt | 67 | 3249 | 3264 | 3633 |
| 559277 | 147 | 162 | AAATCTTGATTTTGGC | Deoxy, MOE, and cEt | 75 | 3251 | 3266 | 110 |
| 561028 | 149 | 164 | GCAAATCTTGATTTTG | Deoxy, MOE, and cEt | 53 | 3253 | 3268 | 3634 |
| 561029 | 151 | 166 | TAGCAAATCTTGATTT | Deoxy, MOE, and cEt | 27 | 3255 | 3270 | 3635 |
| 561030 | 153 | 168 | CATAGCAAATCTTGAT | Deoxy, MOE, and cEt | 63 | 3257 | 3272 | 3636 |
| 561031 | 155 | 170 | AACATAGCAAATCTTG | Deoxy, MOE, and cEt | 56 | 3259 | 3274 | 3637 |
| 561032 | 157 | 172 | CTAACATAGCAAATCT | Deoxy, MOE, and cEt | 67 | 3261 | 3276 | 3638 |
| 561033 | 159 | 174 | GTCTAACATAGCAAAT | Deoxy, MOE, and cEt | 51 | 3263 | 3278 | 3639 |
| 561034 | 174 | 189 | TAAAATTTTACATCG | Deoxy, MOE, and cEt | 4 | 3278 | 3293 | 3640 |
| 561035 | 177 | 192 | GGCTAAAATTTTACA | Deoxy, MOE, and cEt | 0 | 3281 | 3296 | 3641 |
| 561036 | 182 | 197 | CCATTGGCTAAAATTT | Deoxy, MOE, and cEt | 3 | 3286 | 3301 | 3642 |
| 561037 | 184 | 199 | GGCCATTGGCTAAAAT | Deoxy, MOE, and cEt | 16 | 3288 | 3303 | 3643 |
| 561038 | 186 | 201 | GAGGCCATTGGCTAAA | Deoxy, MOE, and cEt | 42 | 3290 | 3305 | 3644 |
| 561039 | 188 | 203 | AGGAGGCCATTGGCTA | Deoxy, MOE, and cEt | 61 | 3292 | 3307 | 3645 |
| 561040 | 190 | 205 | GAAGGAGGCCATTGGC | Deoxy, MOE, and cEt | 35 | 3294 | 3309 | 3646 |
| 561041 | 192 | 207 | CTGAAGGAGGCCATTG | Deoxy, MOE, and cEt | 37 | 3296 | 3311 | 3647 |
| 561042 | 194 | 209 | AACTGAAGGAGGCCAT | Deoxy, MOE, and cEt | 22 | 3298 | 3313 | 3648 |
| 561043 | 196 | 211 | CCAACTGAAGGAGGCC | Deoxy, MOE, and cEt | 33 | 3300 | 3315 | 3649 |
| 561044 | 198 | 213 | TCCCAACTGAAGGAGG | Deoxy, MOE, and cEt | 19 | 3302 | 3317 | 3650 |
| 561045 | 200 | 215 | TGTCCCAACTGAAGGA | Deoxy, MOE, and cEt | 33 | 3304 | 3319 | 3651 |
| 561046 | 202 | 217 | CATGTCCCAACTGAAG | Deoxy, MOE, and cEt | 19 | 3306 | 3321 | 3652 |
| 561047 | 204 | 219 | ACCATGTCCCAACTGA | Deoxy, MOE, and cEt | 19 | 3308 | 3323 | 3653 |
| 561048 | 206 | 221 | AGACCATGTCCCAACT | Deoxy, MOE, and cEt | 19 | 3310 | 3325 | 3654 |
| 561049 | 208 | 223 | TAAGACCATGTCCCAA | Deoxy, MOE, and cEt | 0 | 3312 | 3327 | 3655 |
| 561050 | 210 | 225 | TTTAAGACCATGTCCC | Deoxy, MOE, and cEt | 5 | 3314 | 3329 | 3656 |
| 561051 | 212 | 227 | TCTTTAAGACCATGTC | Deoxy, MOE, and cEt | 10 | 3316 | 3331 | 3657 |
| 561052 | 214 | 229 | AGTCTTTAAGACCATG | Deoxy, MOE, and cEt | 10 | 3318 | 3333 | 3658 |
| 561053 | 216 | 231 | AAAGTCTTTAAGACCA | Deoxy, MOE, and cEt | 29 | 3320 | 3335 | 3659 |
| 561054 | 218 | 233 | ACAAAGTCTTTAAGAC | Deoxy, MOE, and cEt | 19 | 3322 | 3337 | 3660 |
| 561055 | 220 | 235 | GGACAAAGTCTTTAAG | Deoxy, MOE, and cEt | 21 | 3324 | 3339 | 3661 |
| 561056 | 222 | 237 | ATGGACAAAGTCTTTA | Deoxy, MOE, and cEt | 12 | 3326 | 3341 | 3662 |
| 561057 | 224 | 239 | TTATGGACAAAGTCTT | Deoxy, MOE, and cEt | 10 | 3328 | 3343 | 3663 |
| 561058 | 226 | 241 | TCTTATGGACAAAGTC | Deoxy, MOE, and cEt | 9 | 3330 | 3345 | 3664 |
| 561059 | 228 | 243 | CGTCTTATGGACAAAG | Deoxy, MOE, and cEt | 0 | 3332 | 3347 | 3665 |
| 561060 | 242 | 257 | TTAATTTGGCCCTTCG | Deoxy, MOE, and cEt | 28 | 3346 | 3361 | 3666 |
| 561061 | 244 | 259 | CATTAATTTGGCCCTT | Deoxy, MOE, and cEt | 13 | 3348 | 3363 | 3667 |
| 561062 | 246 | 261 | GTCATTAATTTGGCCC | Deoxy, MOE, and cEt | 63 | 3350 | 3365 | 3668 |
| 561063 | 248 | 263 | ATGTCATTAATTTGGC | Deoxy, MOE, and cEt | 37 | 3352 | 3367 | 3669 |
| 561064 | 267 | 282 | TATGTTGAGTTTTTGA | Deoxy, MOE, and cEt | 16 | 3371 | 3386 | 3670 |
| 561065 | 272 | 287 | TCAAATATGTTGAGTT | Deoxy, MOE, and cEt | 21 | 3376 | 3391 | 3671 |
| 561066 | 274 | 289 | GATCAAATATGTTGAG | Deoxy, MOE, and cEt | 36 | 3378 | 3393 | 3672 |
| 560990 | 709 | 724 | TTCTTGGTGCTCTTGG | Deoxy, MOE, and cEt | 73 | 6722 | 6737 | 111 |
| 337487 | 804 | 823 | CACTTGTATGTTCACCTCTG | 5-10-5 MOE | 76 | 7389 | 7408 | 28 |
| 561604 | 1850 | 1865 | GTACAATTACCAGTCC | Deoxy, MOE, and cEt | 59 | 10822 | 10837 | 3673 |
| 561605 | 1852 | 1867 | CTGTACAATTACCAGT | Deoxy, MOE, and cEt | 54 | 10824 | 10839 | 3674 |
| 561606 | 1854 | 1869 | AACTGTACAATTACCA | Deoxy, MOE, and cEt | 57 | 10826 | 10841 | 3675 |
| 561607 | 1856 | 1871 | AGAACTGTACAATTAC | Deoxy, MOE, and cEt | 36 | 10828 | 10843 | 3676 |
| 561608 | 1858 | 1873 | TAAGAACTGTACAATT | Deoxy, MOE, and cEt | 29 | 10830 | 10845 | 3677 |
| 561609 | 1862 | 1877 | CATTTAAGAACTGTAC | Deoxy, MOE, and cEt | 24 | 10834 | 10849 | 3678 |
| 561610 | 1870 | 1885 | TACTACAACATTTAAG | Deoxy, MOE, and cEt | 1 | 10842 | 10857 | 3679 |
| 561611 | 1874 | 1889 | TTAATACTACAACATT | Deoxy, MOE, and cEt | 0 | 10846 | 10861 | 3680 |
| 561612 | 1880 | 1895 | TTGAAATTAATACTAC | Deoxy, MOE, and cEt | 6 | 10852 | 10867 | 3681 |
| 561613 | 1883 | 1898 | GTTTTGAAATTAATAC | Deoxy, MOE, and cEt | 34 | 10855 | 10870 | 3682 |
| 561614 | 1892 | 1907 | CGATTTTTAGTTTTGA | Deoxy, MOE, and cEt | 22 | 10864 | 10879 | 3683 |
| 561615 | 1894 | 1909 | GACGATTTTTAGTTTT | Deoxy, MOE, and cEt | 29 | 10866 | 10881 | 3684 |
| 561616 | 1896 | 1911 | CTGACGATTTTTAGTT | Deoxy, MOE, and cEt | 50 | 10868 | 10883 | 3685 |
| 561617 | 1898 | 1913 | TGCTGACGATTTTTAG | Deoxy, MOE, and cEt | 54 | 10870 | 10885 | 3686 |
| 561618 | 1900 | 1915 | TGTGCTGACGATTTTT | Deoxy, MOE, and cEt | 70 | 10872 | 10887 | 3687 |
| 561619 | 1902 | 1917 | TCTGTGCTGACGATTT | Deoxy, MOE, and cEt | 69 | 10874 | 10889 | 3688 |
| 561620 | 1904 | 1919 | ACTCTGTGCTGACGAT | Deoxy, MOE, and cEt | 78 | 10876 | 10891 | 135 |
| 561621 | 1906 | 1921 | ATACTCTGTGCTGACG | Deoxy, MOE, and cEt | 87 | 10878 | 10893 | 134 |
| 561622 | 1908 | 1923 | ACATACTCTGTGCTGA | Deoxy, MOE, and cEt | 80 | 10880 | 10895 | 136 |
| 561623 | 1911 | 1926 | TACACATACTCTGTGC | Deoxy, MOE, and cEt | 61 | 10883 | 10898 | 3689 |
| 561624 | 1913 | 1928 | TTTACACATACTCTGT | Deoxy, MOE, and cEt | 68 | 10885 | 10900 | 3690 |
| 561625 | 1917 | 1932 | GATTTTACACATACT | Deoxy, MOE, and cEt | 17 | 10889 | 10904 | 3691 |
| 561626 | 1946 | 1961 | GAAGCATCAGTTTAAA | Deoxy, MOE, and cEt | 27 | 10918 | 10933 | 3692 |

TABLE 150-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561627 | 1948 | 1963 | ATGAAGCATCAGTTTA | Deoxy, MOE, and cEt | 5 | 10920 | 10935 | 3693 |
| 561628 | 1956 | 1971 | GTAGCAAAATGAAGCA | Deoxy, MOE, and cEt | 73 | 10928 | 10943 | 137 |
| 561629 | 1958 | 1973 | TTGTAGCAAAATGAAG | Deoxy, MOE, and cEt | 42 | 10930 | 10945 | 3694 |
| 561630 | 1976 | 1991 | CATTTACTCCAAATTA | Deoxy, MOE, and cEt | 43 | 10948 | 10963 | 3695 |
| 561631 | 1981 | 1996 | TCAAACATTTACTCCA | Deoxy, MOE, and cEt | 82 | 10953 | 10968 | 138 |
| 561632 | 2006 | 2021 | CATTAGGTTTCATAAA | Deoxy, MOE, and cEt | 19 | 10978 | 10993 | 3696 |
| 561633 | 2008 | 2023 | TTCATTAGGTTTCATA | Deoxy, MOE, and cEt | 15 | 10980 | 10995 | 3697 |
| 561634 | 2010 | 2025 | GCTTCATTAGGTTTCA | Deoxy, MOE, and cEt | 57 | 10982 | 10997 | 3698 |
| 561635 | 2012 | 2027 | CTGCTTCATTAGGTTT | Deoxy, MOE, and cEt | 0 | 10984 | 10999 | 3699 |
| 561636 | 2014 | 2029 | TTCTGCTTCATTAGGT | Deoxy, MOE, and cEt | 65 | 10986 | 11001 | 3700 |
| 561637 | 2016 | 2031 | AATTCTGCTTCATTAG | Deoxy, MOE, and cEt | 48 | 10988 | 11003 | 3701 |
| 561638 | 2024 | 2039 | CAGTATTTAATTCTGC | Deoxy, MOE, and cEt | 38 | 10996 | 11011 | 3702 |
| 561639 | 2039 | 2054 | GAACTTATTTTAATAC | Deoxy, MOE, and cEt | 29 | 11011 | 11026 | 3703 |
| 561640 | 2041 | 2056 | GCGAACTTATTTTAAT | Deoxy, MOE, and cEt | 38 | 11013 | 11028 | 3704 |
| 561641 | 2043 | 2058 | CAGCGAACTTATTTTA | Deoxy, MOE, and cEt | 46 | 11015 | 11030 | 3705 |
| 561642 | 2045 | 2060 | GACAGCGAACTTATTT | Deoxy, MOE, and cEt | 64 | 11017 | 11032 | 3706 |
| 561643 | 2047 | 2062 | AAGACAGCGAACTTAT | Deoxy, MOE, and cEt | 19 | 11019 | 11034 | 3707 |
| 561644 | 2049 | 2064 | TAAAGACAGCGAACTT | Deoxy, MOE, and cEt | 76 | 11021 | 11036 | 139 |
| 561645 | 2051 | 2066 | TTTAAAGACAGCGAAC | Deoxy, MOE, and cEt | 49 | 11023 | 11038 | 3708 |
| 561646 | 2053 | 2068 | TGTTTAAAGACAGCGA | Deoxy, MOE, and cEt | 81 | 11025 | 11040 | 140 |
| 561647 | 2065 | 2080 | GTCATCTCCATTTGTT | Deoxy, MOE, and cEt | 60 | 11037 | 11052 | 3709 |
| 561648 | 2067 | 2082 | TAGTCATCTCCATTTG | Deoxy, MOE, and cEt | 69 | 11039 | 11054 | 3710 |
| 561649 | 2069 | 2084 | AGTAGTCATCTCCATT | Deoxy, MOE, and cEt | 82 | 11041 | 11056 | 141 |
| 561650 | 2071 | 2086 | TTAGTAGTCATCTCCA | Deoxy, MOE, and cEt | 79 | 11043 | 11058 | 142 |
| 561651 | 2073 | 2088 | ACTTAGTAGTCATCTC | Deoxy, MOE, and cEt | 66 | 11045 | 11060 | 3711 |
| 561652 | 2075 | 2090 | TGACTTAGTAGTCATC | Deoxy, MOE, and cEt | 62 | 11047 | 11062 | 3712 |
| 561653 | 2077 | 2092 | TGTGACTTAGTAGTCA | Deoxy, MOE, and cEt | 52 | 11049 | 11064 | 3713 |
| 561654 | 2079 | 2094 | AATGTGACTTAGTAGT | Deoxy, MOE, and cEt | 44 | 11051 | 11066 | 3714 |
| 561655 | 2081 | 2096 | TCAATGTGACTTAGTA | Deoxy, MOE, and cEt | 65 | 11053 | 11068 | 3715 |
| 561656 | 2083 | 2098 | AGTCAATGTGACTTAG | Deoxy, MOE, and cEt | 70 | 11055 | 11070 | 3716 |
| 561657 | 2085 | 2100 | AAAGTCAATGTGACTT | Deoxy, MOE, and cEt | 2 | 11057 | 11072 | 3717 |
| 561658 | 2087 | 2102 | TTAAAGTCAATGTGAC | Deoxy, MOE, and cEt | 15 | 11059 | 11074 | 3718 |
| 561659 | 2089 | 2104 | TGTTAAAGTCAATGTG | Deoxy, MOE, and cEt | 27 | 11061 | 11076 | 3719 |
| 561660 | 2091 | 2106 | CATGTTAAAGTCAATG | Deoxy, MOE, and cEt | 51 | 11063 | 11078 | 3720 |
| 561661 | 2093 | 2108 | CTCATGTTAAAGTCAA | Deoxy, MOE, and cEt | 53 | 11065 | 11080 | 3721 |
| 561662 | 2095 | 2110 | ACCTCATGTTAAAGTC | Deoxy, MOE, and cEt | 55 | 11067 | 11082 | 3722 |
| 561663 | 2097 | 2112 | ATACCTCATGTTAAAG | Deoxy, MOE, and cEt | 25 | 11069 | 11084 | 3723 |
| 561664 | 2099 | 2114 | TGATACCTCATGTTAA | Deoxy, MOE, and cEt | 0 | 110711 | 1086 | 3724 |
| 561665 | 2101 | 2116 | AGTGATACCTCATGTT | Deoxy, MOE, and cEt | 38 | 110731 | 1088 | 3725 |
| 561666 | 2103 | 2118 | ATAGTGATACCTCATG | Deoxy, MOE, and cEt | 61 | 110751 | 1090 | 3726 |
| 561667 | 2105 | 2120 | GTATAGTGATACCTCA | Deoxy, MOE, and cEt | 63 | 110771 | 1092 | 3727 |
| 561668 | 2107 | 2122 | AGGTATAGTGATACCT | Deoxy, MOE, and cEt | 27 | 110791 | 1094 | 3728 |
| 561669 | 2109 | 2124 | TAAGGTATAGTGATAC | Deoxy, MOE, and cEt | 34 | 110811 | 1096 | 3729 |
| 561670 | 2111 | 2126 | AATAAGGTATAGTGAT | Deoxy, MOE, and cEt | 22 | 110831 | 1098 | 3730 |

TABLE 151

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562220 | N/A | N/A | GTAAACTTATTGATAA | Deoxy, MOE, and cEt | 0 | 7670 | 7685 | 3731 |
| 562221 | N/A | N/A | GGCATAGTAAACTTAT | Deoxy, MOE, and cEt | 22 | 7676 | 7691 | 3732 |
| 562222 | N/A | N/A | AATTTTGGCATAGTAA | Deoxy, MOE, and cEt | 0 | 7682 | 7697 | 3733 |
| 562223 | N/A | N/A | GGCAATTAATGAATTT | Deoxy, MOE, and cEt | 15 | 7693 | 7708 | 3734 |
| 562224 | N/A | N/A | GTGAAAGGCAATTAAT | Deoxy, MOE, and cEt | 7 | 7699 | 7714 | 3735 |
| 562225 | N/A | N/A | AGTTAAGTGAAAGGCA | Deoxy, MOE, and cEt | 0 | 7705 | 7720 | 3736 |
| 562226 | N/A | N/A | CCCAAAAGTTAAGTGA | Deoxy, MOE, and cEt | 27 | 7711 | 7726 | 3737 |
| 562227 | N/A | N/A | TATGGTCCCAAAAGTT | Deoxy, MOE, and cEt | 35 | 7717 | 7732 | 3738 |
| 562228 | N/A | N/A | ATTTATTATGGTCCCA | Deoxy, MOE, and cEt | 67 | 7723 | 7738 | 3739 |
| 562229 | N/A | N/A | GTTATGGCAATACATT | Deoxy, MOE, and cEt | 37 | 7744 | 7759 | 3740 |
| 562230 | N/A | N/A | ATAATGTTATGGCAA | Deoxy, MOE, and cEt | 33 | 7750 | 7765 | 3741 |
| 562231 | N/A | N/A | GTAGTTTATTAATGTT | Deoxy, MOE, and cEt | 15 | 7757 | 7772 | 3742 |
| 562232 | N/A | N/A | TGTAAGGTAGTTTATT | Deoxy, MOE, and cEt | 23 | 7763 | 7778 | 3743 |
| 562233 | N/A | N/A | TGGTTTTGTAAGGTAG | Deoxy, MOE, and cEt | 43 | 7769 | 7784 | 3744 |
| 562234 | N/A | N/A | AATTGGTGGTTTTGTA | Deoxy, MOE, and cEt | 18 | 7775 | 7790 | 3745 |
| 562235 | N/A | N/A | GATTTTAATTGGTGGT | Deoxy, MOE, and cEt | 21 | 7781 | 7796 | 3746 |

TABLE 151-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562236 | N/A | N/A | GATGTAAATAACACTT | Deoxy, MOE, and cEt | 9 | 7809 | 7824 | 3747 |
| 562237 | N/A | N/A | TTGACAGATGTAAATA | Deoxy, MOE, and cEt | 11 | 7815 | 7830 | 3748 |
| 562238 | N/A | N/A | TTTATGTTGACAGATG | Deoxy, MOE, and cEt | 20 | 7821 | 7836 | 3749 |
| 562239 | N/A | N/A | AGTAGATTTATGTTGA | Deoxy, MOE, and cEt | 9 | 7827 | 7842 | 3750 |
| 562240 | N/A | N/A | CCTGAATATAATGAAT | Deoxy, MOE, and cEt | 29 | 7859 | 7874 | 3751 |
| 562241 | N/A | N/A | GGACTACCTGAATATA | Deoxy, MOE, and cEt | 17 | 7865 | 7880 | 3752 |
| 562242 | N/A | N/A | ACCATCAAGCCTCCCA | Deoxy, MOE, and cEt | 45 | 7956 | 7971 | 3753 |
| 562243 | N/A | N/A | CCCCTTACCATCAAGC | Deoxy, MOE, and cEt | 31 | 7962 | 7977 | 3754 |
| 562244 | N/A | N/A | TGTAGTCCCCTTACCA | Deoxy, MOE, and cEt | 16 | 7968 | 7983 | 3755 |
| 562245 | N/A | N/A | ATTGAATGTAGTCCCC | Deoxy, MOE, and cEt | 19 | 7974 | 7989 | 3756 |
| 562246 | N/A | N/A | GATTAGCAAGTGAATG | Deoxy, MOE, and cEt | 6 | 7994 | 8009 | 3757 |
| 562247 | N/A | N/A | TTTGTAGATTAGCAAG | Deoxy, MOE, and cEt | 24 | 8000 | 8015 | 3758 |
| 562248 | N/A | N/A | AAGAGGTTCTCAGTAA | Deoxy, MOE, and cEt | 28 | 8019 | 8034 | 3759 |
| 562249 | N/A | N/A | GTCCATAAGAGGTTCT | Deoxy, MOE, and cEt | 34 | 8025 | 8040 | 3760 |
| 562250 | N/A | N/A | TACCTGGTCCATAAGA | Deoxy, MOE, and cEt | 10 | 8031 | 8046 | 3761 |
| 562251 | N/A | N/A | TCCTAATACCTGGTCC | Deoxy, MOE, and cEt | 32 | 8037 | 8052 | 3762 |
| 562252 | N/A | N/A | TACTTTTCCTAATACC | Deoxy, MOE, and cEt | 20 | 8043 | 8058 | 3763 |
| 562253 | N/A | N/A | CGTTACTACTTTTCCT | Deoxy, MOE, and cEt | 29 | 8049 | 8064 | 3764 |
| 562254 | N/A | N/A | CTGAGACTGCTTCTCG | Deoxy, MOE, and cEt | 36 | 8067 | 8082 | 3765 |
| 562255 | N/A | N/A | TGAAGGCTGAGACTGC | Deoxy, MOE, and cEt | 40 | 8073 | 8088 | 3766 |
| 562256 | N/A | N/A | TAAATTATATGAAGGC | Deoxy, MOE, and cEt | 9 | 8082 | 8097 | 3767 |
| 562257 | N/A | N/A | GTAATTGTTTGATAAT | Deoxy, MOE, and cEt | 0 | 8097 | 8112 | 3768 |
| 562258 | N/A | N/A | TACTAACAAATGTGTA | Deoxy, MOE, and cEt | 0 | 8110 | 8125 | 3769 |
| 562259 | N/A | N/A | GTAATTTACTAACAAA | Deoxy, MOE, and cEt | 0 | 8116 | 8131 | 3770 |
| 562260 | N/A | N/A | ATAAGTGTAATTTACT | Deoxy, MOE, and cEt | 0 | 8122 | 8137 | 3771 |
| 562261 | N/A | N/A | GTTGTAATAAGTGTAA | Deoxy, MOE, and cEt | 0 | 8128 | 8143 | 3772 |
| 562262 | N/A | N/A | GTGATAAATATAATTC | Deoxy, MOE, and cEt | 0 | 8155 | 8170 | 3773 |
| 562263 | N/A | N/A | CATGTAATTGTGATAA | Deoxy, MOE, and cEt | 20 | 8164 | 8179 | 3774 |
| 562264 | N/A | N/A | GTATATTTAAGAACAG | Deoxy, MOE, and cEt | 13 | 8181 | 8196 | 3775 |
| 562265 | N/A | N/A | TTGTGATAAGTATATT | Deoxy, MOE, and cEt | 3 | 8190 | 8205 | 3776 |
| 562266 | N/A | N/A | TGGAATTAAATTGTGA | Deoxy, MOE, and cEt | 0 | 8200 | 8215 | 3777 |
| 562267 | N/A | N/A | AAGCCGTGGAATTAAA | Deoxy, MOE, and cEt | 10 | 8206 | 8221 | 3778 |
| 562268 | N/A | N/A | CATTGTAAGCCGTGGA | Deoxy, MOE, and cEt | 54 | 8212 | 8227 | 3779 |
| 562269 | N/A | N/A | TATGATCATTGTAAGC | Deoxy, MOE, and cEt | 0 | 8218 | 8233 | 3780 |
| 562270 | N/A | N/A | TATAGTTATGATCATT | Deoxy, MOE, and cEt | 0 | 8224 | 8239 | 3781 |
| 562271 | N/A | N/A | GACATAACATTTAATC | Deoxy, MOE, and cEt | 21 | 8258 | 8273 | 3782 |
| 562272 | N/A | N/A | ACTTATGACATAACAT | Deoxy, MOE, and cEt | 14 | 8264 | 8279 | 3783 |
| 562273 | N/A | N/A | GTTACTACTTATGACA | Deoxy, MOE, and cEt | 30 | 8270 | 8285 | 3784 |
| 562274 | N/A | N/A | GTAACAGTTACTACTT | Deoxy, MOE, and cEt | 24 | 8276 | 8291 | 3785 |
| 562275 | N/A | N/A | GCTTATTTGTAACAGT | Deoxy, MOE, and cEt | 17 | 8284 | 8299 | 3786 |
| 562276 | N/A | N/A | TTCACAGCTTATTTGT | Deoxy, MOE, and cEt | 20 | 8290 | 8305 | 3787 |
| 562277 | N/A | N/A | GTTCTTTTCACAGCTT | Deoxy, MOE, and cEt | 46 | 8296 | 8311 | 3788 |
| 562278 | N/A | N/A | GGAGTGGTTCTTTTCA | Deoxy, MOE, and cEt | 35 | 8302 | 8317 | 3789 |
| 562279 | N/A | N/A | ATGCTAGGAGTGGTTC | Deoxy, MOE, and cEt | 29 | 8308 | 8323 | 3790 |
| 562280 | N/A | N/A | TGACTAATGCTAGGAG | Deoxy, MOE, and cEt | 4 | 8314 | 8329 | 3791 |
| 562281 | N/A | N/A | ATAGAGTGACTAATGC | Deoxy, MOE, and cEt | 23 | 8320 | 8335 | 3792 |
| 562282 | N/A | N/A | GAGAGAATAGAGTGAC | Deoxy, MOE, and cEt | 15 | 8326 | 8341 | 3793 |
| 562284 | N/A | N/A | ATTGATATGTAAAACG | Deoxy, MOE, and cEt | 7 | 8347 | 8362 | 3794 |
| 562285 | N/A | N/A | CAATTAATTGATATGT | Deoxy, MOE, and cEt | 14 | 8353 | 8368 | 3795 |
| 562286 | N/A | N/A | CCTTTTAACTTCCAAT | Deoxy, MOE, and cEt | 40 | 8365 | 8380 | 3796 |
| 562287 | N/A | N/A | CCTGGTCCTTTTAACT | Deoxy, MOE, and cEt | 29 | 8371 | 8386 | 3797 |
| 562288 | N/A | N/A | GAGTTTCCTGGTCCTT | Deoxy, MOE, and cEt | 49 | 8377 | 8392 | 3798 |
| 562289 | N/A | N/A | ATGTCTGAGTTTCCTG | Deoxy, MOE, and cEt | 16 | 8383 | 8398 | 3799 |
| 562290 | N/A | N/A | TACTGTATGTCTGAGT | Deoxy, MOE, and cEt | 33 | 8389 | 8404 | 3800 |
| 562291 | N/A | N/A | CCATACATTCTATATA | Deoxy, MOE, and cEt | 10 | 8437 | 8452 | 3801 |
| 562292 | N/A | N/A | TATAAGCCATACATTC | Deoxy, MOE, and cEt | 24 | 8443 | 8458 | 3802 |
| 562293 | N/A | N/A | ATTCATTATAAGCCAT | Deoxy, MOE, and cEt | 38 | 8449 | 8464 | 3803 |
| 562295 | N/A | N/A | CATTGAGTTAACTAAT | Deoxy, MOE, and cEt | 7 | 8463 | 8478 | 3804 |
| 562296 | N/A | N/A | AATTTGCATTGAGTTA | Deoxy, MOE, and cEt | 18 | 8469 | 8484 | 3805 |
| 561144 | 525 | 540 | TGAAGTTACTTCTGGG | Deoxy, MOE, and cEt | 39 | 3629 | 3644 | 3806 |
| 561145 | 527 | 542 | AGTGAAGTTACTTCTG | Deoxy, MOE, and cEt | 51 | 3631 | 3646 | 3807 |
| 561146 | 529 | 544 | TAAGTGAAGTTACTTC | Deoxy, MOE, and cEt | 40 | 3633 | 3648 | 3808 |
| 561147 | 533 | 548 | GTTTTAAGTGAAGTTA | Deoxy, MOE, and cEt | 29 | N/A | N/A | 3809 |
| 561148 | 535 | 550 | AAGTTTTAAGTGAAGT | Deoxy, MOE, and cEt | 19 | N/A | N/A | 3810 |
| 561149 | 547 | 562 | GTTTTTCTACAAAAGT | Deoxy, MOE, and cEt | 38 | 4285 | 4300 | 3811 |
| 561150 | 560 | 575 | ATGCTATTATCTTGTT | Deoxy, MOE, and cEt | 30 | 4298 | 4313 | 3812 |
| 561151 | 562 | 577 | TGATGCTATTATCTTG | Deoxy, MOE, and cEt | 36 | 4300 | 4315 | 3813 |
| 561152 | 564 | 579 | TTTGATGCTATTATCT | Deoxy, MOE, and cEt | 23 | 4302 | 4317 | 3814 |
| 561153 | 567 | 582 | GTCTTTGATGCTATTA | Deoxy, MOE, and cEt | 51 | 4305 | 4320 | 3815 |
| 561154 | 569 | 584 | AGGTCTTTGATGCTAT | Deoxy, MOE, and cEt | 60 | 4307 | 4322 | 3816 |
| 561155 | 571 | 586 | GAAGGTCTTTGATGCT | Deoxy, MOE, and cEt | 61 | 4309 | 4324 | 3817 |
| 561156 | 573 | 588 | GAGAAGGTCTTTGATG | Deoxy, MOE, and cEt | 30 | 4311 | 4326 | 3818 |
| 561157 | 575 | 590 | TGGAGAAGGTCTTTGA | Deoxy, MOE, and cEt | 40 | 4313 | 4328 | 3819 |

TABLE 151-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561158 | 577 | 592 | TCTGGAGAAGGTCTTT | Deoxy, MOE, and cEt | 46 | 4315 | 4330 | 3820 |
| 561159 | 579 | 594 | GGTCTGGAGAAGGTCT | Deoxy, MOE, and cEt | 57 | 4317 | 4332 | 3821 |
| 561160 | 581 | 596 | ACGGTCTGGAGAAGGT | Deoxy, MOE, and cEt | 57 | 4319 | 4334 | 3822 |
| 561161 | 583 | 598 | CCACGGTCTGGAGAAG | Deoxy, MOE, and cEt | 56 | 4321 | 4336 | 3823 |
| 561162 | 585 | 600 | TTCCACGGTCTGGAGA | Deoxy, MOE, and cEt | 50 | 4323 | 4338 | 3824 |
| 561163 | 587 | 602 | TCTTCCACGGTCTGGA | Deoxy, MOE, and cEt | 77 | 4325 | 4340 | 3825 |
| 561164 | 589 | 604 | GGTCTTCCACGGTCTG | Deoxy, MOE, and cEt | 89 | 4327 | 4342 | 3826 |
| 561165 | 591 | 606 | TTGGTCTTCCACGGTC | Deoxy, MOE, and cEt | 79 | 4329 | 4344 | 3827 |
| 561166 | 593 | 608 | TATTGGTCTTCCACGG | Deoxy, MOE, and cEt | 39 | 4331 | 4346 | 3828 |
| 561167 | 595 | 610 | TATATTGGTCTTCCAC | Deoxy, MOE, and cEt | 22 | 4333 | 4348 | 3829 |
| 561168 | 597 | 612 | TTTATATTGGTCTTCC | Deoxy, MOE, and cEt | 43 | 4335 | 4350 | 3830 |
| 561169 | 599 | 614 | TGTTTATATTGGTCTT | Deoxy, MOE, and cEt | 50 | 4337 | 4352 | 3831 |
| 561170 | 601 | 616 | ATTGTTTATATTGGTC | Deoxy, MOE, and cEt | 27 | 4339 | 4354 | 3832 |
| 561171 | 603 | 618 | TAATTGTTTATATTGG | Deoxy, MOE, and cEt | 21 | 4341 | 4356 | 3833 |
| 561172 | 607 | 622 | GGTTTAATTGTTTATA | Deoxy, MOE, and cEt | 22 | 4345 | 4360 | 3834 |
| 561173 | 610 | 625 | GTTGGTTTAATTGTTT | Deoxy, MOE, and cEt | 33 | 4348 | 4363 | 3835 |
| 561174 | 612 | 627 | CTGTTGGTTTAATTGT | Deoxy, MOE, and cEt | 13 | 4350 | 4365 | 3836 |
| 561175 | 614 | 629 | TGCTGTTGGTTTAATT | Deoxy, MOE, and cEt | 26 | 4352 | 4367 | 3837 |
| 561176 | 616 | 631 | TATGCTGTTGGTTTAA | Deoxy, MOE, and cEt | 40 | 4354 | 4369 | 3838 |
| 561177 | 618 | 633 | ACTATGCTGTTGGTTT | Deoxy, MOE, and cEt | 68 | 4356 | 4371 | 3839 |
| 561178 | 620 | 635 | TGACTATGCTGTTGGT | Deoxy, MOE, and cEt | 64 | 4358 | 4373 | 3840 |
| 561179 | 622 | 637 | TTTGACTATGCTGTTG | Deoxy, MOE, and cEt | 42 | 4360 | 4375 | 3841 |
| 561180 | 624 | 639 | TATTTGACTATGCTGT | Deoxy, MOE, and cEt | 16 | 4362 | 4377 | 3842 |
| 561181 | 626 | 641 | TTTATTTGACTATGCT | Deoxy, MOE, and cEt | 17 | 4364 | 4379 | 3843 |
| 561182 | 628 | 643 | CTTTTATTTGACTATG | Deoxy, MOE, and cEt | 7 | 4366 | 4381 | 3844 |
| 561183 | 645 | 660 | GAGCTGATTTTCTATT | Deoxy, MOE, and cEt | 18 | N/A | N/A | 3845 |
| 561184 | 647 | 662 | CTGAGCTGATTTTCTA | Deoxy, MOE, and cEt | 42 | N/A | N/A | 3846 |
| 561185 | 649 | 664 | TTCTGAGCTGATTTTC | Deoxy, MOE, and cEt | 32 | N/A | N/A | 3847 |
| 561186 | 651 | 666 | CCTTCTGAGCTGATTT | Deoxy, MOE, and cEt | 14 | N/A | N/A | 3848 |
| 561187 | 653 | 668 | GTCCTTCTGAGCTGAT | Deoxy, MOE, and cEt | 39 | 6666 | 6681 | 3849 |
| 561188 | 655 | 670 | TAGTCCTTCTGAGCTG | Deoxy, MOE, and cEt | 7 | 6668 | 6683 | 3850 |
| 561189 | 657 | 672 | ACTAGTCCTTCTGAGC | Deoxy, MOE, and cEt | 32 | 6670 | 6685 | 3851 |
| 561190 | 659 | 674 | ATACTAGTCCTTCTGA | Deoxy, MOE, and cEt | 19 | 6672 | 6687 | 3852 |
| 561191 | 661 | 676 | GAATACTAGTCCTTCT | Deoxy, MOE, and cEt | 37 | 6674 | 6689 | 3853 |
| 561192 | 663 | 678 | TTGAATACTAGTCCTT | Deoxy, MOE, and cEt | 50 | 6676 | 6691 | 3854 |
| 561193 | 665 | 680 | TCTTGAATACTAGTCC | Deoxy, MOE, and cEt | 28 | 6678 | 6693 | 3855 |
| 561194 | 667 | 682 | GTTCTTGAATACTAGT | Deoxy, MOE, and cEt | 34 | 6680 | 6695 | 3856 |
| 561195 | 669 | 684 | GGGTTCTTGAATACTA | Deoxy, MOE, and cEt | 61 | 6682 | 6697 | 3857 |
| 561196 | 671 | 686 | GTGGGTTCTTGAATAC | Deoxy, MOE, and cEt | 21 | 6684 | 6699 | 3858 |
| 561197 | 673 | 688 | CTGTGGGTTCTTGAAT | Deoxy, MOE, and cEt | 45 | 6686 | 6701 | 3859 |
| 561198 | 675 | 690 | TTCTGTGGGTTCTTGA | Deoxy, MOE, and cEt | 0 | 6688 | 6703 | 3860 |
| 561199 | 679 | 694 | AAATTTCTGTGGGTTC | Deoxy, MOE, and cEt | 31 | 6692 | 6707 | 3861 |
| 561200 | 681 | 696 | AGAAATTTCTGTGGGT | Deoxy, MOE, and cEt | 60 | 6694 | 6709 | 3862 |
| 561201 | 684 | 699 | TAGAGAAATTTCTGTG | Deoxy, MOE, and cEt | 35 | 6697 | 6712 | 3863 |
| 561202 | 686 | 701 | GATAGAGAAATTTCTG | Deoxy, MOE, and cEt | 36 | 6699 | 6714 | 3864 |
| 561203 | 694 | 709 | GCTTGGAAGATAGAGA | Deoxy, MOE, and cEt | 39 | 6707 | 6722 | 3865 |
| 561204 | 696 | 711 | TGGCTTGGAAGATAGA | Deoxy, MOE, and cEt | 32 | 6709 | 6724 | 3866 |
| 561205 | 698 | 713 | CTTGGCTTGGAAGATA | Deoxy, MOE, and cEt | 23 | 6711 | 6726 | 3867 |
| 561206 | 700 | 715 | CTCTTGGCTTGGAAGA | Deoxy, MOE, and cEt | 21 | 6713 | 6728 | 3868 |
| 561207 | 702 | 717 | TGCTCTTGGCTTGGAA | Deoxy, MOE, and cEt | 34 | 6715 | 6730 | 3869 |
| 561208 | 704 | 719 | GGTGCTCTTGGCTTGG | Deoxy, MOE, and cEt | 71 | 6717 | 6732 | 118 |
| 561209 | 706 | 721 | TTGGTGCTCTTGGCTT | Deoxy, MOE, and cEt | 59 | 6719 | 6734 | 3870 |
| 561210 | 708 | 723 | TCTTGGTGCTCTTGGC | Deoxy, MOE, and cEt | 65 | 6721 | 6736 | 3871 |
| 560990 | 709 | 724 | TTCTTGGTGCTCTTGG | Deoxy, MOE, and cEt | 54 | 6722 | 6737 | 111 |
| 561211 | 710 | 725 | GTTCTTGGTGCTCTTG | Deoxy, MOE, and cEt | 60 | 6723 | 6738 | 3872 |
| 561212 | 712 | 727 | TAGTTCTTGGTGCTCT | Deoxy, MOE, and cEt | 53 | 6725 | 6740 | 3873 |
| 561213 | 714 | 729 | AGTAGTTCTTGGTGCT | Deoxy, MOE, and cEt | 50 | 6727 | 6742 | 3874 |
| 561214 | 716 | 731 | GGAGTAGTTCTTGGTG | Deoxy, MOE, and cEt | 31 | 6729 | 6744 | 3875 |
| 561215 | 718 | 733 | AGGGAGTAGTTCTTGG | Deoxy, MOE, and cEt | 0 | 6731 | 6746 | 3876 |
| 561216 | 720 | 735 | AAAGGGAGTAGTTCTT | Deoxy, MOE, and cEt | 25 | 6733 | 6748 | 3877 |
| 561217 | 722 | 737 | AGAAAGGGAGTAGTTC | Deoxy, MOE, and cEt | 28 | 6735 | 6750 | 3878 |
| 561218 | 724 | 739 | GAAGAAAGGGAGTAGT | Deoxy, MOE, and cEt | 10 | 6737 | 6752 | 3879 |
| 561219 | 726 | 741 | CTGAAGAAAGGGAGTA | Deoxy, MOE, and cEt | 47 | 6739 | 6754 | 3880 |
| 561220 | 730 | 745 | TCAACTGAAGAAAGGG | Deoxy, MOE, and cEt | 50 | 6743 | 6758 | 3881 |
| 337487 | 804 | 823 | CACTTGTATGTTCACCTCTG | 5-10-5 MOE | 52 | 7389 | 7408 | 28 |
| 561297 | 926 | 941 | TCATTGAAGTTTTGTG | Deoxy, MOE, and cEt | 28 | 7913 | 7928 | 3882 |
| 561298 | 930 | 945 | CGTTTCATTGAAGTTT | Deoxy, MOE, and cEt | 35 | 7917 | 7932 | 3883 |
| 561299 | 944 | 959 | TTGTAGTTCTCCCACG | Deoxy, MOE, and cEt | 30 | 7931 | 7946 | 3884 |
| 561300 | 946 | 961 | ATTTGTAGTTCTCCCA | Deoxy, MOE, and cEt | 32 | 7933 | 7948 | 3885 |
| 561301 | 948 | 963 | ATATTTGTAGTTCTCC | Deoxy, MOE, and cEt | 24 | 7935 | 7950 | 3886 |
| 561302 | 950 | 965 | CCATATTTGTAGTTCT | Deoxy, MOE, and cEt | 5 | 7937 | 7952 | 3887 |
| 561303 | 952 | 967 | AACCATATTTGTAGTT | Deoxy, MOE, and cEt | 3 | 7939 | 7954 | 3888 |
| 561304 | 956 | 971 | CCAAAACCATATTTGT | Deoxy, MOE, and cEt | 19 | 7943 | 7958 | 3889 |

TABLE 151-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561305 | 959 | 974 | CTCCCAAAACCATATT | Deoxy, MOE, and cEt | 23 | 7946 | 7961 | 3890 |
| 561306 | 961 | 976 | GCCTCCCAAAACCATA | Deoxy, MOE, and cEt | 25 | 7948 | 7963 | 3891 |
| 561307 | 963 | 978 | AAGCCTCCCAAAACCA | Deoxy, MOE, and cEt | 30 | 7950 | 7965 | 3892 |
| 561308 | 965 | 980 | TCAAGCCTCCCAAAAC | Deoxy, MOE, and cEt | 16 | 7952 | 7967 | 3893 |
| 561309 | 969 | 984 | TCCATCAAGCCTCCCA | Deoxy, MOE, and cEt | 46 | N/A | N/A | 3894 |
| 561310 | 971 | 986 | TCTCCATCAAGCCTCC | Deoxy, MOE, and cEt | 13 | N/A | N/A | 3895 |
| 561311 | 973 | 988 | ATTCTCCATCAAGCCT | Deoxy, MOE, and cEt | 16 | N/A | N/A | 3896 |
| 561312 | 975 | 990 | AAATTCTCCATCAAGC | Deoxy, MOE, and cEt | 20 | N/A | N/A | 3897 |
| 561313 | 979 | 994 | ACCAAAATTCTCCATC | Deoxy, MOE, and cEt | 18 | N/A | N/A | 3898 |
| 561314 | 981 | 996 | CAACCAAAATTCTCCA | Deoxy, MOE, and cEt | 26 | N/A | N/A | 3899 |
| 561315 | 983 | 998 | CCCAACCAAAATTCTC | Deoxy, MOE, and cEt | 38 | 9558 | 9573 | 3900 |
| 559316 | 985 | 1000 | GGCCCAACCAAAATTC | Deoxy, MOE, and cEt | 14 | 9560 | 9575 | 3901 |
| 561316 | 987 | 1002 | TAGGCCCAACCAAAAT | Deoxy, MOE, and cEt | 38 | 9562 | 9577 | 3902 |
| 51317 | 989 | 1004 | TCTAGGCCCAACCAAA | Deoxy, MOE, and cEt | 51 | 9564 | 9579 | 3903 |
| 561318 | 991 | 1006 | TCTCTAGGCCCAACCA | Deoxy, MOE, and cEt | 35 | 9566 | 9581 | 3904 |
| 561319 | 993 | 1008 | CTTCTCTAGGCCCAAC | Deoxy, MOE, and cEt | 31 | 9568 | 9583 | 3905 |
| 561320 | 995 | 1010 | ATCTTCTCTAGGCCCA | Deoxy, MOE, and cEt | 68 | 9570 | 9585 | 119 |
| 561321 | 997 | 1012 | ATATCTTCTCTAGGCC | Deoxy, MOE, and cEt | 30 | 9572 | 9587 | 3906 |
| 561322 | 999 | 1014 | GTATATCTTCTCTAGG | Deoxy, MOE, and cEt | 25 | 9574 | 9589 | 3907 |
| 561323 | 1001 | 1016 | GAGTATATCTTCTCTA | Deoxy, MOE, and cEt | 26 | 9576 | 9591 | 3908 |
| 561324 | 1003 | 1018 | TGGAGTATATCTTCTC | Deoxy, MOE, and cEt | 46 | 9578 | 9593 | 3909 |
| 561325 | 1005 | 1020 | TATGGAGTATATCTTC | Deoxy, MOE, and cEt | 20 | 9580 | 9595 | 3910 |
| 561326 | 1007 | 1022 | ACTATGGAGTATATCT | Deoxy, MOE, and cEt | 20 | 9582 | 9597 | 3911 |
| 561327 | 1009 | 1024 | TCACTATGGAGTATAT | Deoxy, MOE, and cEt | 22 | 9584 | 9599 | 3912 |
| 561328 | 1011 | 1026 | CTTCACTATGGAGTAT | Deoxy, MOE, and cEt | 33 | 9586 | 9601 | 3913 |
| 561329 | 1013 | 1028 | TGCTTCACTATGGAGT | Deoxy, MOE, and cEt | 50 | 9588 | 9603 | 3914 |
| 561330 | 1015 | 1030 | ATTGCTTCACTATGGA | Deoxy, MOE, and cEt | 43 | 9590 | 9605 | 3915 |
| 561331 | 1017 | 1032 | AGATTGCTTCACTATG | Deoxy, MOE, and cEt | 31 | 9592 | 9607 | 3916 |
| 561332 | 1019 | 1034 | TTAGATTGCTTCACTA | Deoxy, MOE, and cEt | 36 | 9594 | 9609 | 3917 |
| 561333 | 1021 | 1036 | AATTAGATTGCTTCAC | Deoxy, MOE, and cEt | 17 | 9596 | 9611 | 3918 |
| 561334 | 1023 | 1038 | ATAATTAGATTGCTTC | Deoxy, MOE, and cEt | 23 | 9598 | 9613 | 3919 |
| 561335 | 1025 | 1040 | ACATAATTAGATTGCT | Deoxy, MOE, and cEt | 13 | 9600 | 9615 | 3920 |
| 561336 | 1031 | 1046 | CGTAAAACATAATTAG | Deoxy, MOE, and cEt | 25 | 9606 | 9621 | 3921 |
| 561337 | 1045 | 1060 | CTTCCAACTCAATTCG | Deoxy, MOE, and cEt | 0 | 9620 | 9635 | 3922 |
| 561338 | 1047 | 1062 | GTCTTCCAACTCAATT | Deoxy, MOE, and cEt | 0 | 9622 | 9637 | 3923 |
| 561339 | 1049 | 1064 | CAGTCTTCCAACTCAA | Deoxy, MOE, and cEt | 15 | 9624 | 9639 | 3924 |
| 561340 | 1051 | 1066 | TCCAGTCTTCCAACTC | Deoxy, MOE, and cEt | 22 | 9626 | 9641 | 3925 |
| 561341 | 1053 | 1068 | TTTCCAGTCTTCCAAC | Deoxy, MOE, and cEt | 2 | 9628 | 9643 | 3926 |
| 561342 | 1056 | 1071 | GTCTTTCCAGTCTTCC | Deoxy, MOE, and cEt | 45 | 9631 | 9651 | 3928 |
| 561345 | 1063 | 1078 | GTTTGTTGTCTTTCCA | Deoxy, MOE, and cEt | 57 | 9638 | 9653 | 121 |
| 561346 | 1068 | 1083 | ATAATGTTTGTTGTCT | Deoxy, MOE, and cEt | 6 | 9643 | 9658 | 3929 |
| 561347 | 1098 | 1113 | GTGATTTCCCAAGTAA | Deoxy, MOE, and cEt | 66 | 9673 | 9688 | 122 |
| 561348 | 1113 | 1128 | CGTATAGTTGGTTTCG | Deoxy, MOE, and cEt | 54 | 9688 | 9703 | 3930 |
| 561349 | 1127 | 1142 | GCAACTAGATGTAGCG | Deoxy, MOE, and cEt | 50 | 9702 | 9717 | 3931 |
| 561350 | 1129 | 1144 | TCGCAACTAGATGTAG | Deoxy, MOE, and cEt | 9 | 9704 | 9719 | 3932 |
| 561351 | 1131 | 1146 | AATCGCAACTAGATGT | Deoxy, MOE, and cEt | 9 | 9706 | 9721 | 3933 |
| 561352 | 1133 | 1148 | GTAATCGCAACTAGAT | Deoxy, MOE, and cEt | 15 | 9708 | 9723 | 3934 |
| 561353 | 1135 | 1150 | CAGTAATCGCAACTAG | Deoxy, MOE, and cEt | 41 | 9710 | 9725 | 3935 |
| 561354 | 1137 | 1152 | GCCAGTAATCGCAACT | Deoxy, MOE, and cEt | 38 | 9712 | 9727 | 3936 |
| 561355 | 1139 | 1154 | TTGCCAGTAATCGCAA | Deoxy, MOE, and cEt | 32 | 9714 | 9729 | 3937 |
| 561356 | 1141 | 1156 | CATTGCCAGTAATCGC | Deoxy, MOE, and cEt | 54 | 9716 | 9731 | 3938 |
| 561357 | 1143 | 1158 | GACATTGCCAGTAATC | Deoxy, MOE, and cEt | 20 | 9718 | 9733 | 3939 |
| 561358 | 1145 | 1160 | GGGACATTGCCAGTAA | Deoxy, MOE, and cEt | 0 | 9720 | 9735 | 3940 |
| 561359 | 1160 | 1175 | TCCGGGATTGCATTGG | Deoxy, MOE, and cEt | 43 | 9735 | 9750 | 3941 |
| 561360 | 1162 | 1177 | TTTCCGGGATTGCATT | Deoxy, MOE, and cEt | 31 | 9737 | 9752 | 3942 |
| 561361 | 1164 | 1179 | GTTTTCCGGGATTGCA | Deoxy, MOE, and cEt | 31 | 9739 | 9754 | 3943 |
| 561362 | 1166 | 1181 | TTGTTTTCCGGGATTG | Deoxy, MOE, and cEt | 36 | 9741 | 9756 | 3944 |
| 561363 | 1168 | 1183 | CTTTGTTTTCCGGGAT | Deoxy, MOE, and cEt | 22 | 9743 | 9758 | 3945 |
| 561364 | 1170 | 1185 | ATCTTTGTTTTCCGGG | Deoxy, MOE, and cEt | 13 | 9745 | 9760 | 3946 |
| 561365 | 1172 | 1187 | AAATCTTTGTTTTCCG | Deoxy, MOE, and cEt | 7 | 9747 | 9762 | 3947 |
| 561366 | 1177 | 1192 | ACACCAAATCTTTGTT | Deoxy, MOE, and cEt | 8 | 9752 | 9767 | 3948 |
| 561367 | 1179 | 1194 | AAACACCAAATCTTTG | Deoxy, MOE, and cEt | 11 | 9754 | 9769 | 3949 |
| 561368 | 1187 | 1202 | CAAGTAGAAAACACCA | Deoxy, MOE, and cEt | 16 | 9762 | 9777 | 3950 |
| 561369 | 1189 | 1204 | CCCAAGTAGAAAACAC | Deoxy, MOE, and cEt | 23 | 9764 | 9779 | 3951 |
| 561370 | 1191 | 1206 | ATCCCAAGTAGAAAAC | Deoxy, MOE, and cEt | 27 | 9766 | 9781 | 3952 |
| 561371 | 1193 | 1208 | TGATCCCAAGTAGAAA | Deoxy, MOE, and cEt | 25 | 9768 | 9783 | 3953 |
| 561372 | 1195 | 1210 | TGTGATCCCAAGTAGA | Deoxy, MOE, and cEt | 45 | 9770 | 9785 | 3954 |

TABLE 152

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561067 | 276 | 291 | CTGATCAAATATGTTG | Deoxy, MOE, and cEt | 54 | 3380 | 3395 | 3955 |
| 561068 | 278 | 293 | GACTGATCAAATATGT | Deoxy, MOE, and cEt | 19 | 3382 | 3397 | 3956 |
| 561069 | 280 | 295 | AAGACTGATCAAATAT | Deoxy, MOE, and cEt | 17 | 3384 | 3399 | 3957 |
| 561070 | 286 | 301 | CATAAAAAGACTGATC | Deoxy, MOE, and cEt | 18 | 3390 | 3405 | 3958 |
| 561071 | 289 | 304 | GATCATAAAAAGACTG | Deoxy, MOE, and cEt | 11 | 3393 | 3408 | 3959 |
| 561072 | 291 | 306 | TAGATCATAAAAAGAC | Deoxy, MOE, and cEt | 0 | 3395 | 3410 | 3960 |
| 561073 | 293 | 308 | GATAGATCATAAAAAG | Deoxy, MOE, and cEt | 15 | 3397 | 3412 | 3961 |
| 561074 | 295 | 310 | GCGATAGATCATAAAA | Deoxy, MOE, and cEt | 39 | 3399 | 3414 | 3962 |
| 561075 | 297 | 312 | CAGCGATAGATCATAA | Deoxy, MOE, and cEt | 53 | 3401 | 3416 | 3963 |
| 561076 | 299 | 314 | TGCAGCGATAGATCAT | Deoxy, MOE, and cEt | 70 | 3403 | 3418 | 159 |
| 561077 | 301 | 316 | TTTGCAGCGATAGATC | Deoxy, MOE, and cEt | 60 | 3405 | 3420 | 3964 |
| 561078 | 303 | 318 | GGTTTGCAGCGATAGA | Deoxy, MOE, and cEt | 63 | 3407 | 3422 | 3965 |
| 561079 | 305 | 320 | CTGGTTTGCAGCGATA | Deoxy, MOE, and cEt | 76 | 3409 | 3424 | 160 |
| 561080 | 307 | 322 | CACTGGTTTGCAGCGA | Deoxy, MOE, and cEt | 65 | 3411 | 3426 | 3966 |
| 561081 | 309 | 324 | TTCACTGGTTTGCAGC | Deoxy, MOE, and cEt | 45 | 3413 | 3428 | 3967 |
| 561082 | 311 | 326 | ATTTCACTGGTTTGCA | Deoxy, MOE, and cEt | 56 | 3415 | 3430 | 3968 |
| 561083 | 313 | 328 | TGATTTCACTGGTTTG | Deoxy, MOE, and cEt | 65 | 3417 | 3432 | 3969 |
| 561084 | 316 | 331 | CTTTGATTTCACTGGT | Deoxy, MOE, and cEt | 73 | 3420 | 3435 | 161 |
| 561085 | 341 | 356 | GTTCTTCTCAGTTCCT | Deoxy, MOE, and cEt | 79 | 3445 | 3460 | 162 |
| 561086 | 343 | 358 | TAGTTCTTCTCAGTTC | Deoxy, MOE, and cEt | 50 | 3447 | 3462 | 3970 |
| 561087 | 345 | 360 | TGTAGTTCTTCTCAGT | Deoxy, MOE, and cEt | 42 | 3449 | 3464 | 3971 |
| 561088 | 347 | 362 | TATGTAGTTCTTCTCA | Deoxy, MOE, and cEt | 27 | 3451 | 3466 | 3972 |
| 561089 | 349 | 364 | TATATGTAGTTCTTCT | Deoxy, MOE, and cEt | 37 | 3453 | 3468 | 3973 |
| 561090 | 352 | 367 | GTTTATATGTAGTTCT | Deoxy, MOE, and cEt | 39 | 3456 | 3471 | 3974 |
| 561091 | 355 | 370 | GTAGTTTATATGTAGT | Deoxy, MOE, and cEt | 55 | 3459 | 3474 | 3975 |
| 561092 | 358 | 373 | CTTGTAGTTTATATGT | Deoxy, MOE, and cEt | 48 | 3462 | 3477 | 3976 |
| 561093 | 360 | 375 | GACTTGTAGTTTATAT | Deoxy, MOE, and cEt | 43 | 3464 | 3479 | 3977 |
| 561094 | 362 | 377 | TTGACTTGTAGTTTAT | Deoxy, MOE, and cEt | 35 | 3466 | 3481 | 3978 |
| 561095 | 365 | 380 | TTTTTGACTTGTAGTT | Deoxy, MOE, and cEt | 37 | 3469 | 3484 | 3979 |
| 561096 | 367 | 382 | CATTTTTGACTTGTAG | Deoxy, MOE, and cEt | 34 | 3471 | 3486 | 3980 |
| 561097 | 373 | 388 | CCTCTTCATTTTTGAC | Deoxy, MOE, and cEt | 48 | 3477 | 3492 | 3981 |
| 561098 | 386 | 401 | GACATATTCTTTACCT | Deoxy, MOE, and cEt | 40 | 3490 | 3505 | 3982 |
| 561099 | 388 | 403 | GTGACATATTCTTTAC | Deoxy, MOE, and cEt | 43 | 3492 | 3507 | 3983 |
| 561100 | 393 | 408 | TTCAAGTGACATATTC | Deoxy, MOE, and cEt | 51 | 3497 | 3512 | 3984 |
| 561101 | 395 | 410 | AGTTCAAGTGACATAT | Deoxy, MOE, and cEt | 27 | 3499 | 3514 | 3985 |
| 561102 | 397 | 412 | TGAGTTCAAGTGACAT | Deoxy, MOE, and cEt | 63 | 3501 | 3516 | 3986 |
| 561103 | 399 | 414 | GTTGAGTTCAAGTGAC | Deoxy, MOE, and cEt | 48 | 3503 | 3518 | 3987 |
| 561104 | 401 | 416 | GAGTTGAGTTCAAGTG | Deoxy, MOE, and cEt | 57 | 3505 | 3520 | 3988 |
| 561105 | 403 | 418 | TTGAGTTGAGTTCAAG | Deoxy, MOE, and cEt | 32 | 3507 | 3522 | 3989 |
| 561106 | 405 | 420 | TTTTGAGTTGAGTTCA | Deoxy, MOE, and cEt | 47 | 3509 | 3524 | 3990 |
| 561107 | 407 | 422 | AGTTTTGAGTTGAGTT | Deoxy, MOE, and cEt | 46 | 3511 | 3526 | 3991 |
| 561108 | 409 | 424 | CAAGTTTTGAGTTGAG | Deoxy, MOE, and cEt | 48 | 3513 | 3528 | 3992 |
| 561109 | 411 | 426 | TTCAAGTTTTGAGTTG | Deoxy, MOE, and cEt | 17 | 3515 | 3530 | 3993 |
| 561110 | 413 | 428 | CTTTCAAGTTTTGAGT | Deoxy, MOE, and cEt | 48 | 3517 | 3532 | 3994 |
| 561111 | 415 | 430 | GGCTTTCAAGTTTTGA | Deoxy, MOE, and cEt | 56 | 3519 | 3534 | 3995 |
| 561112 | 417 | 432 | GAGGCTTTCAAGTTTT | Deoxy, MOE, and cEt | 39 | 3521 | 3536 | 3996 |
| 561113 | 419 | 434 | AGGAGGCTTTCAAGTT | Deoxy, MOE, and cEt | 49 | 3523 | 3538 | 3997 |
| 561114 | 421 | 436 | CTAGGAGGCTTTCAAG | Deoxy, MOE, and cEt | 49 | 3525 | 3540 | 3998 |
| 561115 | 423 | 438 | TTCTAGGAGGCTTTCA | Deoxy, MOE, and cEt | 40 | 3527 | 3542 | 3999 |
| 561116 | 425 | 440 | TCTTCTAGGAGGCTTT | Deoxy, MOE, and cEt | 66 | 3529 | 3544 | 4000 |
| 561117 | 427 | 442 | TTTCTTCTAGGAGGCT | Deoxy, MOE, and cEt | 74 | 3531 | 3546 | 4001 |
| 561118 | 442 | 457 | GTTGAAGTAGAATTTT | Deoxy, MOE, and cEt | 40 | 3546 | 3561 | 4002 |
| 561119 | 469 | 484 | GTTGCTCTTCTAAATA | Deoxy, MOE, and cEt | 44 | 3573 | 3588 | 4003 |
| 561120 | 471 | 486 | TAGTTGCTCTTCTAAA | Deoxy, MOE, and cEt | 19 | 3575 | 3590 | 4004 |
| 561121 | 473 | 488 | GTTAGTTGCTCTTCTA | Deoxy, MOE, and cEt | 67 | 3577 | 3592 | 4005 |
| 561122 | 475 | 490 | TAGTTAGTTGCTCTTC | Deoxy, MOE, and cEt | 51 | 3579 | 3594 | 4006 |
| 561123 | 477 | 492 | GTTAGTTAGTTGCTCT | Deoxy, MOE, and cEt | 73 | 3581 | 3596 | 163 |
| 561124 | 479 | 494 | AAGTTAGTTAGTTGCT | Deoxy, MOE, and cEt | 51 | 3583 | 3598 | 4007 |
| 561125 | 481 | 496 | TTAAGTTAGTTAGTTG | Deoxy, MOE, and cEt | 33 | 3585 | 3600 | 4008 |
| 561126 | 483 | 498 | AATTAAGTTAGTTAGT | Deoxy, MOE, and cEt | 0 | 3587 | 3602 | 4009 |
| 561127 | 485 | 500 | TGAATTAAGTTAGTTA | Deoxy, MOE, and cEt | 5 | 3589 | 3604 | 4010 |
| 561128 | 487 | 502 | TTTGAATTAAGTTAGT | Deoxy, MOE, and cEt | 18 | 3591 | 3606 | 4011 |
| 561129 | 494 | 509 | GGTTGATTTTGAATTA | Deoxy, MOE, and cEt | 20 | 3598 | 3613 | 4012 |
| 561130 | 496 | 511 | CAGGTTGATTTTGAAT | Deoxy, MOE, and cEt | 27 | 3600 | 3615 | 4013 |
| 561131 | 498 | 513 | TTCAGGTTGATTTTGA | Deoxy, MOE, and cEt | 33 | 3602 | 3617 | 4014 |
| 561132 | 500 | 515 | GTTTCAGGTTGATTTT | Deoxy, MOE, and cEt | 38 | 3604 | 3619 | 4015 |
| 561133 | 502 | 517 | GAGTTTCAGGTTGATT | Deoxy, MOE, and cEt | 33 | 3606 | 3621 | 4016 |
| 561134 | 504 | 519 | TGGAGTTTCAGGTTGA | Deoxy, MOE, and cEt | 67 | 3608 | 3623 | 4017 |
| 561135 | 507 | 522 | TTCTGGAGTTTCAGGT | Deoxy, MOE, and cEt | 32 | 3611 | 3626 | 4018 |
| 561136 | 509 | 524 | TGTTCTGGAGTTTCAG | Deoxy, MOE, and cEt | 14 | 3613 | 3628 | 4019 |
| 561137 | 511 | 526 | GGTGTTCTGGAGTTTC | Deoxy, MOE, and cEt | 23 | 3615 | 3630 | 4020 |
| 561138 | 513 | 528 | TGGGTGTTCTGGAGTT | Deoxy, MOE, and cEt | 30 | 3617 | 3632 | 4021 |
| 561139 | 515 | 530 | TCTGGGTGTTCTGGAG | Deoxy, MOE, and cEt | 24 | 3619 | 3634 | 4022 |

TABLE 152-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561140 | 517 | 532 | CTTCTGGGTGTTCTGG | Deoxy, MOE, and cEt | 17 | 3621 | 3636 | 4023 |
| 561141 | 519 | 534 | TACTTCTGGGTGTTCT | Deoxy, MOE, and cEt | 10 | 3623 | 3638 | 4024 |
| 561142 | 521 | 536 | GTTACTTCTGGGTGTT | Deoxy, MOE, and cEt | 11 | 3625 | 3640 | 4025 |
| 561143 | 523 | 538 | AAGTTACTTCTGGGTG | Deoxy, MOE, and cEt | 15 | 3627 | 3642 | 4026 |
| 560990 | 709 | 724 | TTCTTGGTGCTCTTGG | Deoxy, MOE, and cEt | 79 | 6722 | 6737 | 111 |
| 561221 | 758 | 773 | CCATCATGTTTTACAT | Deoxy, MOE, and cEt | 17 | 6771 | 6786 | 4027 |
| 561222 | 760 | 775 | TGCCATCATGTTTTAC | Deoxy, MOE, and cEt | 22 | N/A | N/A | 4028 |
| 561223 | 763 | 778 | GAATGCCATCATGTTT | Deoxy, MOE, and cEt | 12 | N/A | N/A | 4029 |
| 561224 | 765 | 780 | AGGAATGCCATCATGT | Deoxy, MOE, and cEt | 26 | N/A | N/A | 4030 |
| 561225 | 767 | 782 | GCAGGAATGCCATCAT | Deoxy, MOE, and cEt | 32 | N/A | N/A | 4031 |
| 561226 | 769 | 784 | CAGCAGGAATGCCATC | Deoxy, MOE, and cEt | 29 | N/A | N/A | 4032 |
| 561227 | 771 | 786 | TTCAGCAGGAATGCCA | Deoxy, MOE, and cEt | 22 | N/A | N/A | 4033 |
| 561228 | 773 | 788 | CATTCAGCAGGAATGC | Deoxy, MOE, and cEt | 23 | 7358 | 7373 | 4034 |
| 561229 | 775 | 790 | TACATTCAGCAGGAAT | Deoxy, MOE, and cEt | 28 | 7360 | 7375 | 4035 |
| 561230 | 777 | 792 | GGTACATTCAGCAGGA | Deoxy, MOE, and cEt | 61 | 7362 | 7377 | 4036 |
| 561231 | 779 | 794 | GTGGTACATTCAGCAG | Deoxy, MOE, and cEt | 57 | 7364 | 7379 | 4037 |
| 561232 | 781 | 796 | TGGTGGTACATTCAGC | Deoxy, MOE, and cEt | 59 | 7366 | 7381 | 4038 |
| 561233 | 787 | 802 | TATAAATGGTGGTACA | Deoxy, MOE, and cEt | 51 | 7372 | 7387 | 4039 |
| 561234 | 789 | 804 | GTTATAAATGGTGGTA | Deoxy, MOE, and cEt | 50 | 7374 | 7389 | 4040 |
| 561235 | 791 | 806 | CTGTTATAAATGGTGG | Deoxy, MOE, and cEt | 49 | 7376 | 7391 | 4041 |
| 561236 | 793 | 808 | CTCTGTTATAAATGGT | Deoxy, MOE, and cEt | 39 | 7378 | 7393 | 4042 |
| 561237 | 795 | 810 | ACCTCTGTTATAAATG | Deoxy, MOE, and cEt | 47 | 7380 | 7395 | 4043 |
| 561238 | 797 | 812 | TCACCTCTGTTATAAA | Deoxy, MOE, and cEt | 44 | 7382 | 7397 | 4044 |
| 561239 | 799 | 814 | GTTCACCTCTGTTATA | Deoxy, MOE, and cEt | 43 | 7384 | 7399 | 4045 |
| 561240 | 801 | 816 | ATGTTCACCTCTGTTA | Deoxy, MOE, and cEt | 59 | 7386 | 7401 | 4046 |
| 561241 | 803 | 818 | GTATGTTCACCTCTGT | Deoxy, MOE, and cEt | 69 | 7388 | 7403 | 164 |
| 337487 | 804 | 823 | CACTTGTATGTTCACCTCTG | 5-10-5 MOE | 74 | 7389 | 7408 | 28 |
| 561242 | 805 | 820 | TTGTATGTTCACCTCT | Deoxy, MOE, and cEt | 63 | 7390 | 7405 | 4047 |
| 561243 | 807 | 822 | ACTTGTATGTTCACCT | Deoxy, MOE, and cEt | 63 | 7392 | 7407 | 4048 |
| 561244 | 809 | 824 | CCACTTGTATGTTCAC | Deoxy, MOE, and cEt | 57 | 7394 | 7409 | 4049 |
| 561245 | 811 | 826 | TGCCACTTGTATGTTC | Deoxy, MOE, and cEt | 36 | 7396 | 7411 | 4050 |
| 561246 | 813 | 828 | CATGCCACTTGTATGT | Deoxy, MOE, and cEt | 33 | 7398 | 7413 | 4051 |
| 561247 | 815 | 830 | TACATGCCACTTGTAT | Deoxy, MOE, and cEt | 37 | 7400 | 7415 | 4052 |
| 561248 | 817 | 832 | CATACATGCCACTTGT | Deoxy, MOE, and cEt | 36 | 7402 | 7417 | 4053 |
| 561249 | 819 | 834 | GGCATACATGCCACTT | Deoxy, MOE, and cEt | 20 | 7404 | 7419 | 4054 |
| 561250 | 821 | 836 | ATGGCATACATGCCAC | Deoxy, MOE, and cEt | 0 | 7406 | 7421 | 4055 |
| 561251 | 823 | 838 | TGATGGCATACATGCC | Deoxy, MOE, and cEt | 22 | 7408 | 7423 | 4056 |
| 561252 | 825 | 840 | TCTGATGGCATACATG | Deoxy, MOE, and cEt | 34 | 7410 | 7425 | 4057 |
| 561253 | 827 | 842 | GGTCTGATGGCATACA | Deoxy, MOE, and cEt | 46 | 7412 | 7427 | 4058 |
| 561254 | 829 | 844 | TGGGTCTGATGGCATA | Deoxy, MOE, and cEt | 51 | 7414 | 7429 | 4059 |
| 561255 | 834 | 849 | GTTGCTGGGTCTGATG | Deoxy, MOE, and cEt | 45 | 7419 | 7434 | 4060 |
| 561256 | 836 | 851 | GAGTTGCTGGGTCTGA | Deoxy, MOE, and cEt | 70 | 7421 | 7436 | 165 |
| 561257 | 838 | 853 | GAGAGTTGCTGGGTCT | Deoxy, MOE, and cEt | 57 | 7423 | 7438 | 4061 |
| 561258 | 840 | 855 | TTGAGAGTTGCTGGGT | Deoxy, MOE, and cEt | 47 | 7425 | 7440 | 4062 |
| 561259 | 842 | 857 | ACTTGAGAGTTGCTGG | Deoxy, MOE, and cEt | 53 | 7427 | 7442 | 4063 |
| 561260 | 844 | 859 | AAACTTGAGAGTTGCT | Deoxy, MOE, and cEt | 71 | 7429 | 7444 | 166 |
| 561261 | 846 | 861 | AAAAACTTGAGAGTTG | Deoxy, MOE, and cEt | 23 | 7431 | 7446 | 4064 |
| 561262 | 848 | 863 | TGAAAAACTTGAGAGT | Deoxy, MOE, and cEt | 11 | 7433 | 7448 | 4065 |
| 561263 | 850 | 865 | CATGAAAAACTTGAGA | Deoxy, MOE, and cEt | 34 | 7435 | 7450 | 4066 |
| 561264 | 852 | 867 | GACATGAAAAACTTGA | Deoxy, MOE, and cEt | 25 | 7437 | 7452 | 4067 |
| 561265 | 860 | 875 | TCACAGTAGACATGAA | Deoxy, MOE, and cEt | 16 | 7445 | 7460 | 4068 |
| 561266 | 862 | 877 | CATCACAGTAGACATG | Deoxy, MOE, and cEt | 37 | 7447 | 7462 | 4069 |
| 561267 | 864 | 879 | AACATCACAGTAGACA | Deoxy, MOE, and cEt | 57 | 7449 | 7464 | 4070 |
| 561268 | 866 | 881 | ATAACATCACAGTAGA | Deoxy, MOE, and cEt | 40 | 7451 | 7466 | 4071 |
| 561269 | 868 | 883 | ATATAACATCACAGTA | Deoxy, MOE, and cEt | 26 | 7453 | 7468 | 4072 |
| 561270 | 870 | 885 | TGATATAACATCACAG | Deoxy, MOE, and cEt | 35 | 7455 | 7470 | 4073 |
| 561271 | 872 | 887 | CCTGATATAACATCAC | Deoxy, MOE, and cEt | 60 | 7457 | 7472 | 4074 |
| 561272 | 874 | 889 | TACCTGATATAACATC | Deoxy, MOE, and cEt | 37 | 7459 | 7474 | 4075 |
| 561273 | 876 | 891 | ACTACCTGATATAACA | Deoxy, MOE, and cEt | 24 | N/A | N/A | 4076 |
| 561274 | 878 | 893 | GGACTACCTGATATAA | Deoxy, MOE, and cEt | 7 | N/A | N/A | 4077 |
| 561275 | 880 | 895 | ATGGACTACCTGATAT | Deoxy, MOE, and cEt | 33 | N/A | N/A | 4078 |
| 561276 | 882 | 897 | CCATGGACTACCTGAT | Deoxy, MOE, and cEt | 52 | N/A | N/A | 4079 |
| 561277 | 884 | 899 | GTCCATGGACTACCTG | Deoxy, MOE, and cEt | 71 | 7871 | 7886 | 167 |
| 561278 | 886 | 901 | ATGTCCATGGACTACC | Deoxy, MOE, and cEt | 67 | 7873 | 7888 | 4080 |
| 561279 | 888 | 903 | TAATGTCCATGGACTA | Deoxy, MOE, and cEt | 44 | 7875 | 7890 | 4081 |
| 559390 | 890 | 905 | ATTAATGTCCATGGAC | Deoxy, MOE, and cEt | 28 | 7877 | 7892 | 4082 |
| 561280 | 892 | 907 | GAATTAATGTCCATGG | Deoxy, MOE, and cEt | 51 | 7879 | 7894 | 4083 |
| 561281 | 894 | 909 | TTGAATTAATGTCCAT | Deoxy, MOE, and cEt | 30 | 7881 | 7896 | 4084 |
| 561282 | 896 | 911 | TGTTGAATTAATGTCC | Deoxy, MOE, and cEt | 38 | 7883 | 7898 | 4085 |
| 561283 | 898 | 913 | GATGTTGAATTAATGT | Deoxy, MOE, and cEt | 11 | 7885 | 7900 | 4086 |
| 561284 | 900 | 915 | TCGATGTTGAATTAAT | Deoxy, MOE, and cEt | 20 | 7887 | 7902 | 4087 |
| 561285 | 902 | 917 | ATTCGATGTTGAATTA | Deoxy, MOE, and cEt | 12 | 7889 | 7904 | 4088 |
| 561286 | 904 | 919 | CTATTCGATGTTGAAT | Deoxy, MOE, and cEt | 17 | 7891 | 7906 | 4089 |

TABLE 152-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561287 | 906 | 921 | ATCTATTCGATGTTGA | Deoxy, MOE, and cEt | 32 | 7893 | 7908 | 4090 |
| 561288 | 908 | 923 | CCATCTATTCGATGTT | Deoxy, MOE, and cEt | 69 | 7895 | 7910 | 168 |
| 561289 | 910 | 925 | ATCCATCTATTCGATG | Deoxy, MOE, and cEt | 32 | 7897 | 7912 | 4091 |
| 561290 | 912 | 927 | TGATCCATCTATTCGA | Deoxy, MOE, and cEt | 41 | 7899 | 7914 | 4092 |
| 561291 | 914 | 929 | TGTGATCCATCTATTC | Deoxy, MOE, and cEt | 50 | 7901 | 7916 | 4093 |
| 561292 | 916 | 931 | TTTGTGATCCATCTAT | Deoxy, MOE, and cEt | 50 | 7903 | 7918 | 4094 |
| 561293 | 918 | 933 | GTTTTGTGATCCATCT | Deoxy, MOE, and cEt | 41 | 7905 | 7920 | 4095 |
| 561294 | 920 | 935 | AAGTTTTGTGATCCAT | Deoxy, MOE, and cEt | 56 | 7907 | 7922 | 4096 |
| 561295 | 922 | 937 | TGAAGTTTTGTGATCC | Deoxy, MOE, and cEt | 57 | 7909 | 7924 | 4097 |
| 561296 | 924 | 939 | ATTGAAGTTTTGTGAT | Deoxy, MOE, and cEt | 0 | 7911 | 7926 | 4098 |
| 561450 | 1386 | 1401 | CAACATTTTGGTTGAT | Deoxy, MOE, and cEt | 45 | 10358 | 10373 | 4099 |
| 561451 | 1389 | 1404 | GATCAACATTTTGGTT | Deoxy, MOE, and cEt | 33 | 10361 | 10376 | 4100 |
| 561452 | 1391 | 1406 | TGGATCAACATTTTGG | Deoxy, MOE, and cEt | 81 | 10363 | 10378 | 123 |
| 561453 | 1393 | 1408 | GATGGATCAACATTTT | Deoxy, MOE, and cEt | 59 | 10365 | 10380 | 4101 |
| 561455 | 1397 | 1412 | GTTGGATGGATCAACA | Deoxy, MOE, and cEt | 53 | 10369 | 10384 | 4102 |
| 561456 | 1399 | 1414 | CTGTTGGATGGATCAA | Deoxy, MOE, and cEt | 71 | 10371 | 10386 | 4103 |
| 561457 | 1401 | 1416 | ATCTGTTGGATGGATC | Deoxy, MOE, and cEt | 71 | 10373 | 10388 | 4104 |
| 561458 | 1403 | 1418 | GAATCTGTTGGATGGA | Deoxy, MOE, and cEt | 84 | 10375 | 10390 | 124 |
| 561459 | 1405 | 1420 | CTGAATCTGTTGGATG | Deoxy, MOE, and cEt | 72 | 10377 | 10392 | 4105 |
| 561460 | 1407 | 1422 | TTCTGAATCTGTTGGA | Deoxy, MOE, and cEt | 78 | 10379 | 10394 | 125 |
| 561461 | 1414 | 1429 | CAAAGCTTTCTGAATC | Deoxy, MOE, and cEt | 45 | 10386 | 10401 | 4106 |
| 561462 | 1421 | 1436 | GTTCATTCAAAGCTTT | Deoxy, MOE, and cEt | 87 | 10393 | 10408 | 126 |
| 561463 | 1423 | 1438 | CAGTTCATTCAAAGCT | Deoxy, MOE, and cEt | 85 | 10395 | 10410 | 127 |
| 561464 | 1425 | 1440 | CTCAGTTCATTCAAAG | Deoxy, MOE, and cEt | 47 | 10397 | 10412 | 4107 |
| 561465 | 1427 | 1442 | GCCTCAGTTCATTCAA | Deoxy, MOE, and cEt | 60 | 10399 | 10414 | 4108 |
| 561466 | 1429 | 1444 | TTGCCTCAGTTCATTC | Deoxy, MOE, and cEt | 68 | 10401 | 10416 | 4109 |
| 561467 | 1431 | 1446 | ATTTGCCTCAGTTCAT | Deoxy, MOE, and cEt | 61 | 10403 | 10418 | 4110 |
| 561468 | 1433 | 1448 | AAATTTGCCTCAGTTC | Deoxy, MOE, and cEt | 48 | 10405 | 10420 | 4111 |
| 561469 | 1436 | 1451 | TTTAAATTTGCCTCAG | Deoxy, MOE, and cEt | 59 | 10408 | 10423 | 4112 |
| 561470 | 1438 | 1453 | CTTTTAAATTTGCCTC | Deoxy, MOE, and cEt | 50 | 10410 | 10425 | 4113 |
| 561471 | 1440 | 1455 | GCCTTTTAAATTTGCC | Deoxy, MOE, and cEt | 73 | 10412 | 10427 | 4114 |
| 561472 | 1452 | 1467 | GTTTAAATTATTGCCT | Deoxy, MOE, and cEt | 48 | 10424 | 10439 | 4115 |
| 561473 | 1463 | 1478 | ATGAGGTTAATGTTTA | Deoxy, MOE, and cEt | 33 | 10435 | 10450 | 4116 |
| 561474 | 1465 | 1480 | GAATGAGGTTAATGTT | Deoxy, MOE, and cEt | 29 | 10437 | 10452 | 4117 |
| 561475 | 1467 | 1482 | TGGAATGAGGTTAATG | Deoxy, MOE, and cEt | 66 | 10439 | 10454 | 4118 |
| 561476 | 1469 | 1484 | CTTGGAATGAGGTTAA | Deoxy, MOE, and cEt | 72 | 10441 | 10456 | 4119 |
| 561477 | 1471 | 1486 | AACTTGGAATGAGGTT | Deoxy, MOE, and cEt | 69 | 10443 | 10458 | 4120 |
| 561478 | 1473 | 1488 | TTAACTTGGAATGAGG | Deoxy, MOE, and cEt | 74 | 10445 | 10460 | 128 |
| 561479 | 1475 | 1490 | CATTAACTTGGAATGA | Deoxy, MOE, and cEt | 5 | 10447 | 10462 | 4121 |
| 561480 | 1477 | 1492 | CACATTAACTTGGAAT | Deoxy, MOE, and cEt | 26 | 10449 | 10464 | 4122 |
| 561481 | 1479 | 1494 | ACCACATTAACTTGGA | Deoxy, MOE, and cEt | 59 | 10451 | 10466 | 4123 |
| 561482 | 1481 | 1496 | AGACCACATTAACTTG | Deoxy, MOE, and cEt | 76 | 10453 | 10468 | 129 |
| 561483 | 1483 | 1498 | TTAGACCACATTAACT | Deoxy, MOE, and cEt | 47 | 10455 | 10470 | 4124 |
| 561484 | 1485 | 1500 | TATTAGACCACATTAA | Deoxy, MOE, and cEt | 38 | 10457 | 10472 | 4125 |
| 561485 | 1487 | 1502 | ATTATTAGACCACATT | Deoxy, MOE, and cEt | 59 | 10459 | 10474 | 4126 |
| 561486 | 1489 | 1504 | AGATTATTAGACCACA | Deoxy, MOE, and cEt | 84 | 10461 | 10476 | 130 |
| 561487 | 1491 | 1506 | CCAGATTATTAGACCA | Deoxy, MOE, and cEt | 93 | 10463 | 10478 | 131 |
| 561488 | 1493 | 1508 | TACCAGATTATTAGAC | Deoxy, MOE, and cEt | 22 | 10465 | 10480 | 4127 |
| 561489 | 1495 | 1510 | AATACCAGATTATTAG | Deoxy, MOE, and cEt | 48 | 10467 | 10482 | 4128 |
| 561490 | 1497 | 1512 | TTAATACCAGATTATT | Deoxy, MOE, and cEt | 22 | 10469 | 10484 | 4129 |
| 561491 | 1499 | 1514 | ATTTAATACCAGATTA | Deoxy, MOE, and cEt | 14 | 10471 | 10486 | 4130 |
| 561492 | 1501 | 1516 | GGATTTAATACCAGAT | Deoxy, MOE, and cEt | 74 | 10473 | 10488 | 4131 |
| 561493 | 1503 | 1518 | AAGGATTTAATACCAG | Deoxy, MOE, and cEt | 70 | 10475 | 10490 | 4132 |
| 561494 | 1505 | 1520 | TTAAGGATTTAATACC | Deoxy, MOE, and cEt | 14 | 10477 | 10492 | 4133 |
| 561495 | 1508 | 1523 | CTCTTAAGGATTTAAT | Deoxy, MOE, and cEt | 12 | 10480 | 10495 | 4134 |
| 561496 | 1510 | 1525 | TTCTCTTAAGGATTTA | Deoxy, MOE, and cEt | 47 | 10482 | 10497 | 4135 |
| 561497 | 1513 | 1528 | GCTTTCTCTTAAGGAT | Deoxy, MOE, and cEt | 73 | 10485 | 10500 | 4136 |
| 561498 | 1515 | 1530 | AAGCTTTCTCTTAAGG | Deoxy, MOE, and cEt | 59 | 10487 | 10502 | 4137 |
| 561499 | 1517 | 1532 | TCAAGCTTTCTCTTAA | Deoxy, MOE, and cEt | 62 | 10489 | 10504 | 4138 |
| 561500 | 1526 | 1541 | ATCTATTTCTCAAGCT | Deoxy, MOE, and cEt | 76 | 10498 | 10513 | 132 |
| 561501 | 1547 | 1562 | AGTGACTTTAAGATAA | Deoxy, MOE, and cEt | 23 | 10519 | 10534 | 4139 |
| 561502 | 1549 | 1564 | ACAGTGACTTTAAGAT | Deoxy, MOE, and cEt | 62 | 10521 | 10536 | 4140 |
| 561503 | 1551 | 1566 | AGACAGTGACTTTAAG | Deoxy, MOE, and cEt | 55 | 10523 | 10538 | 4141 |
| 561504 | 1553 | 1568 | ATAGACAGTGACTTTA | Deoxy, MOE, and cEt | 74 | 10525 | 10540 | 133 |
| 561505 | 1555 | 1570 | AAATAGACAGTGACTT | Deoxy, MOE, and cEt | 59 | 10527 | 10542 | 4142 |
| 561506 | 1557 | 1572 | TTAAATAGACAGTGAC | Deoxy, MOE, and cEt | 38 | 10529 | 10544 | 4143 |
| 561507 | 1559 | 1574 | TCTTAAATAGACAGTG | Deoxy, MOE, and cEt | 54 | 10531 | 10546 | 4144 |
| 561508 | 1561 | 1576 | AATCTTAAATAGACAG | Deoxy, MOE, and cEt | 22 | 10533 | 10548 | 4145 |
| 561509 | 1563 | 1578 | TTAATCTTAAATAGAC | Deoxy, MOE, and cEt | 0 | 10535 | 10550 | 4146 |
| 561510 | 1565 | 1580 | GTTTAATCTTAAATAG | Deoxy, MOE, and cEt | 0 | 10537 | 10552 | 4147 |
| 561511 | 1569 | 1584 | GTATGTTTAATCTTAA | Deoxy, MOE, and cEt | 13 | 10541 | 10556 | 4148 |
| 561512 | 1572 | 1587 | ATTGTATGTTTAATCT | Deoxy, MOE, and cEt | 40 | 10544 | 10559 | 4149 |
| 561513 | 1575 | 1590 | GTGATTGTATGTTTAA | Deoxy, MOE, and cEt | 71 | 10547 | 10562 | 4150 |

TABLE 152-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561514 | 1578 | 1593 | TATGTGATTGTATGTT | Deoxy, MOE, and cEt | 58 | 10550 | 10565 | 4151 |
| 561515 | 1580 | 1595 | GTTATGTGATTGTATG | Deoxy, MOE, and cEt | 68 | 10552 | 10567 | 4152 |
| 561516 | 1582 | 1597 | AGGTTATGTGATTGTA | Deoxy, MOE, and cEt | 73 | 10554 | 10569 | 4153 |
| 561517 | 1584 | 1599 | TAAGGTTATGTGATTG | Deoxy, MOE, and cEt | 64 | 10556 | 10571 | 4154 |
| 561518 | 1586 | 1601 | TTTAAGGTTATGTGAT | Deoxy, MOE, and cEt | 0 | 10558 | 10573 | 4155 |
| 561519 | 1588 | 1603 | TCTTTAAGGTTATGTG | Deoxy, MOE, and cEt | 53 | 10560 | 10575 | 4156 |
| 561520 | 1590 | 1605 | ATTCTTTAAGGTTATG | Deoxy, MOE, and cEt | 29 | 10562 | 10577 | 4157 |
| 561521 | 1592 | 1607 | GTATTCTTTAAGGTTA | Deoxy, MOE, and cEt | 24 | 10564 | 10579 | 4158 |
| 561522 | 1594 | 1609 | CGGTATTCTTTAAGGT | Deoxy, MOE, and cEt | 70 | 10566 | 10581 | 4159 |
| 561523 | 1596 | 1611 | AACGGTATTCTTTAAG | Deoxy, MOE, and cEt | 42 | 10568 | 10583 | 4160 |
| 561524 | 1598 | 1613 | TAAACGGTATTCTTTA | Deoxy, MOE, and cEt | 26 | 10570 | 10585 | 4161 |
| 561525 | 1600 | 1615 | TGTAAACGGTATTCTT | Deoxy, MOE, and cEt | 59 | 10572 | 10587 | 4162 |
| 561526 | 1602 | 1617 | AATGTAAACGGTATTC | Deoxy, MOE, and cEt | 57 | 10574 | 10589 | 4142 |

TABLE 153

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561681 | N/A | N/A | TCTGGAAGCAGACCTA | Deoxy, MOE, and cEt | 37 | 3096 | 3111 | 4164 |
| 561682 | N/A | N/A | CTTCTGGAAGCAGACC | Deoxy, MOE, and cEt | 27 | 3098 | 3113 | 4165 |
| 561683 | N/A | N/A | AAATAAGGTATAGTGA | Deoxy, MOE, and cEt | 2 | 11084 | 11099 | 4166 |
| 561684 | N/A | N/A | TAGTATTAAGTGTTAA | Deoxy, MOE, and cEt | 14 | 11133 | 11148 | 4167 |
| 561685 | N/A | N/A | TCATAGTATTAAGTGT | Deoxy, MOE, and cEt | 0 | 11136 | 11151 | 4168 |
| 561686 | N/A | N/A | AGATTCCTTTACAATT | Deoxy, MOE, and cEt | 21 | 11160 | 11175 | 4169 |
| 561687 | N/A | N/A | ACAAGATTCCTTTACA | Deoxy, MOE, and cEt | 21 | 11163 | 11178 | 4170 |
| 561688 | N/A | N/A | CTGACAAGATTCCTTT | Deoxy, MOE, and cEt | 70 | 11166 | 11181 | 4171 |
| 561689 | N/A | N/A | AATCTGACAAGATTCC | Deoxy, MOE, and cEt | 83 | 11169 | 11184 | 180 |
| 561690 | N/A | N/A | TGTAATCTGACAAGAT | Deoxy, MOE, and cEt | 46 | 11172 | 11187 | 4172 |
| 561691 | N/A | N/A | TACTGTAATCTGACAA | Deoxy, MOE, and cEt | 47 | 11175 | 11190 | 4173 |
| 561692 | N/A | N/A | TCTTACTGTAATCTGA | Deoxy, MOE, and cEt | 50 | 11178 | 11193 | 4174 |
| 561693 | N/A | N/A | CATTCTTACTGTAATC | Deoxy, MOE, and cEt | 40 | 11181 | 11196 | 4175 |
| 561694 | N/A | N/A | GTTCATTCTTACTGTA | Deoxy, MOE, and cEt | 71 | 11184 | 11199 | 4176 |
| 561695 | N/A | N/A | ATATGTTCATTCTTAC | Deoxy, MOE, and cEt | 2 | 11188 | 11203 | 4177 |
| 561696 | N/A | N/A | GCCACAAATATGTTCA | Deoxy, MOE, and cEt | 80 | 11195 | 11210 | 4178 |
| 561697 | N/A | N/A | GATGCCACAAATATGT | Deoxy, MOE, and cEt | 70 | 11198 | 11213 | 4179 |
| 561698 | N/A | N/A | CTCGATGCCACAAATA | Deoxy, MOE, and cEt | 80 | 11201 | 11216 | 181 |
| 561699 | N/A | N/A | TAACTCGATGCCACAA | Deoxy, MOE, and cEt | 86 | 11204 | 11219 | 182 |
| 561700 | N/A | N/A | CTTTAACTCGATGCCA | Deoxy, MOE, and cEt | 77 | 11207 | 11222 | 4180 |
| 561701 | N/A | N/A | AAACTTTAACTCGATG | Deoxy, MOE, and cEt | 39 | 11210 | 11225 | 4181 |
| 561702 | N/A | N/A | TATAAACTTTAACTCG | Deoxy, MOE, and cEt | 13 | 11213 | 11228 | 4182 |
| 561703 | N/A | N/A | CACAGCATATTTAGGG | Deoxy, MOE, and cEt | 71 | 11233 | 11248 | 4183 |
| 561704 | N/A | N/A | TAGAATCACAGCATAT | Deoxy, MOE, and cEt | 68 | 11239 | 11254 | 4184 |
| 561705 | N/A | N/A | TATTAGAATCACAGCA | Deoxy, MOE, and cEt | 73 | 11242 | 11257 | 4185 |
| 561706 | N/A | N/A | AATGTATTAGAATCAC | Deoxy, MOE, and cEt | 40 | 11246 | 11261 | 4186 |
| 561707 | N/A | N/A | ACGAATGTATTAGAAT | Deoxy, MOE, and cEt | 22 | 11249 | 11264 | 4187 |
| 561708 | N/A | N/A | TACACGAATGTATTAG | Deoxy, MOE, and cEt | 33 | 11252 | 11267 | 4188 |
| 561709 | N/A | N/A | ACCTACACGAATGTAT | Deoxy, MOE, and cEt | 42 | 11255 | 11270 | 4189 |
| 561710 | N/A | N/A | AAAACCTACACGAATG | Deoxy, MOE, and cEt | 24 | 11258 | 11273 | 4190 |
| 561711 | N/A | N/A | TTGAAAACCTACACGA | Deoxy, MOE, and cEt | 34 | 11261 | 11276 | 4191 |
| 561712 | N/A | N/A | TACTTGAAAACCTACA | Deoxy, MOE, and cEt | 33 | 11264 | 11279 | 4192 |
| 561713 | N/A | N/A | GTTTATTTCTACTTGA | Deoxy, MOE, and cEt | 53 | 11273 | 11288 | 4193 |
| 561714 | N/A | N/A | GAGGTTTATTTCTACT | Deoxy, MOE, and cEt | 69 | 11276 | 11291 | 4194 |
| 561715 | N/A | N/A | TACGAGGTTTATTTCT | Deoxy, MOE, and cEt | 21 | 11279 | 11294 | 4195 |
| 561716 | N/A | N/A | TGTTACGAGGTTTATT | Deoxy, MOE, and cEt | 47 | 11282 | 11297 | 4196 |
| 561717 | N/A | N/A | ACTTGTTACGAGGTTT | Deoxy, MOE, and cEt | 70 | 11285 | 11300 | 4197 |
| 561718 | N/A | N/A | CAGTAACTTGTTACGA | Deoxy, MOE, and cEt | 60 | 11290 | 11305 | 4198 |
| 561719 | N/A | N/A | GTTCAGTAACTTGTTA | Deoxy, MOE, and cEt | 40 | 11293 | 11308 | 4199 |
| 561720 | N/A | N/A | TCAGGCTGTTTAAACG | Deoxy, MOE, and cEt | 59 | 11308 | 11323 | 4200 |
| 561721 | N/A | N/A | TTGTCAGGCTGTTTAA | Deoxy, MOE, and cEt | 74 | 11311 | 11326 | 4201 |
| 561722 | N/A | N/A | TGCTTGTCAGGCTGTT | Deoxy, MOE, and cEt | 82 | 11314 | 11329 | 183 |
| 561723 | N/A | N/A | ACATGCTTGTCAGGCT | Deoxy, MOE, and cEt | 84 | 11317 | 11332 | 184 |
| 561724 | N/A | N/A | TATACATGCTTGTCAG | Deoxy, MOE, and cEt | 75 | 11320 | 11335 | 4202 |
| 561725 | N/A | N/A | GTCTTTGTTTATTGAA | Deoxy, MOE, and cEt | 49 | 11347 | 11362 | 4203 |
| 561726 | N/A | N/A | TGGGTCTTTGTTTATT | Deoxy, MOE, and cEt | 27 | 11350 | 11365 | 4204 |
| 561727 | N/A | N/A | GACTGGGTCTTTGTTT | Deoxy, MOE, and cEt | 20 | 11353 | 11368 | 4205 |

TABLE 153-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561728 | N/A | N/A | ATAATTTAGGGACTGG | Deoxy, MOE, and cEt | 20 | 11363 | 11378 | 4206 |
| 561729 | N/A | N/A | TCTATAATTTAGGGAC | Deoxy, MOE, and cEt | 39 | 11366 | 11381 | 4207 |
| 561730 | N/A | N/A | CGATAAACATGCAAGA | Deoxy, MOE, and cEt | 68 | 11394 | 11409 | 4208 |
| 561731 | N/A | N/A | TGTCGATAAACATGCA | Deoxy, MOE, and cEt | 80 | 11397 | 11412 | 4209 |
| 561732 | N/A | N/A | TGATGTCGATAAACAT | Deoxy, MOE, and cEt | 68 | 11400 | 11415 | 4210 |
| 561733 | N/A | N/A | TTGTGATGTCGATAAA | Deoxy, MOE, and cEt | 28 | 11403 | 11418 | 4211 |
| 561734 | N/A | N/A | CTGTTGTGATGTCGAT | Deoxy, MOE, and cEt | 74 | 11406 | 11421 | 4212 |
| 561735 | N/A | N/A | GATCTGTTGTGATGTC | Deoxy, MOE, and cEt | 59 | 11409 | 11424 | 4213 |
| 561736 | N/A | N/A | AGGGATCTGTTGTGAT | Deoxy, MOE, and cEt | 24 | 11412 | 11427 | 4214 |
| 561737 | N/A | N/A | TTTAGGGATCTGTTGT | Deoxy, MOE, and cEt | 19 | 11415 | 11430 | 4215 |
| 561738 | N/A | N/A | GGATTTAGGGATCTGT | Deoxy, MOE, and cEt | 27 | 11418 | 11433 | 4216 |
| 561739 | N/A | N/A | GATTTAGGGATTTAGG | Deoxy, MOE, and cEt | 44 | 11425 | 11440 | 4217 |
| 561740 | N/A | N/A | TCTTTAGGGATTTAGG | Deoxy, MOE, and cEt | 38 | 11433 | 11448 | 4218 |
| 561741 | N/A | N/A | TAATCTTTAGGGATTT | Deoxy, MOE, and cEt | 0 | 11436 | 11451 | 4219 |
| 561742 | N/A | N/A | ATCTAATCTTTAGGGA | Deoxy, MOE, and cEt | 0 | 11439 | 11454 | 4220 |
| 561743 | N/A | N/A | TGTATCTAATCTTTAG | Deoxy, MOE, and cEt | 15 | 11442 | 11457 | 4221 |
| 561744 | N/A | N/A | AAATTTGTATCTAATC | Deoxy, MOE, and cEt | 21 | 11447 | 11462 | 4222 |
| 561745 | N/A | N/A | GTAAAAAATTTGTATC | Deoxy, MOE, and cEt | 23 | 11452 | 11467 | 4223 |
| 561746 | N/A | N/A | GTGGTAAAAAATTTGT | Deoxy, MOE, and cEt | 32 | 11455 | 11470 | 4224 |
| 561747 | N/A | N/A | GATACTGTGGTAAAAA | Deoxy, MOE, and cEt | 45 | 11461 | 11476 | 4225 |
| 561748 | N/A | N/A | AGTGATACTGTGGTAA | Deoxy, MOE, and cEt | 60 | 11464 | 11479 | 4226 |
| 561749 | N/A | N/A | ACAAGTGATACTGTGG | Deoxy, MOE, and cEt | 75 | 11467 | 11482 | 4227 |
| 561750 | N/A | N/A | CTGACAAGTGATACTG | Deoxy, MOE, and cEt | 59 | 11470 | 11485 | 4228 |
| 561751 | N/A | N/A | ATTCTGACAAGTGATA | Deoxy, MOE, and cEt | 48 | 11473 | 11488 | 4229 |
| 561752 | N/A | N/A | TAAATTCTGACAAGTG | Deoxy, MOE, and cEt | 59 | 11476 | 11491 | 4230 |
| 561753 | N/A | N/A | TACTGGCAGTTTTAAA | Deoxy, MOE, and cEt | 42 | 11508 | 11523 | 4231 |
| 561754 | N/A | N/A | TCTTACTGGCAGTTTT | Deoxy, MOE, and cEt | 51 | 11511 | 11526 | 4232 |
| 561755 | N/A | N/A | ATTTCTTACTGGCAGT | Deoxy, MOE, and cEt | 69 | 11514 | 11529 | 4233 |
| 561756 | N/A | N/A | AAAATTTCTTACTGGC | Deoxy, MOE, and cEt | 57 | 11517 | 11532 | 4234 |
| 561757 | N/A | N/A | AACAAATGGGTTTAAT | Deoxy, MOE, and cEt | 0 | 11535 | 11550 | 4235 |
| 562374 | N/A | N/A | GAATATTTGCAAGTCT | Deoxy, MOE, and cEt | 68 | 9230 | 9245 | 4236 |
| 562375 | N/A | N/A | GTAGAGGAATATTTGC | Deoxy, MOE, and cEt | 83 | 9236 | 9251 | 151 |
| 562376 | N/A | N/A | TCATTGGTAGAGGAAT | Deoxy, MOE, and cEt | 23 | 9242 | 9257 | 4237 |
| 562377 | N/A | N/A | ATATTTAAAGTCTCG | Deoxy, MOE, and cEt | 17 | 9258 | 9273 | 4238 |
| 562378 | N/A | N/A | GTTACATTATTATAGA | Deoxy, MOE, and cEt | 29 | 9273 | 9288 | 4239 |
| 562379 | N/A | N/A | GTGAAATGTGTTACAT | Deoxy, MOE, and cEt | 54 | 9282 | 9297 | 4240 |
| 562380 | N/A | N/A | TCACCAGTGAAATGTG | Deoxy, MOE, and cEt | 64 | 9288 | 9303 | 4241 |
| 562381 | N/A | N/A | CATGTTTCACCAGTGA | Deoxy, MOE, and cEt | 78 | 9294 | 9309 | 4242 |
| 562382 | N/A | N/A | ACAAGACATGTTTCAC | Deoxy, MOE, and cEt | 36 | 9300 | 9315 | 4243 |
| 562383 | N/A | N/A | CATATGACAAGACATG | Deoxy, MOE, and cEt | 42 | 9306 | 9321 | 4244 |
| 562384 | N/A | N/A | CTATAATGCATATGAC | Deoxy, MOE, and cEt | 5 | 9314 | 9329 | 4245 |
| 562385 | N/A | N/A | TCCTTTCTATAATGCA | Deoxy, MOE, and cEt | 65 | 9320 | 9335 | 4246 |
| 562386 | N/A | N/A | TGATTATCCTTTCTAT | Deoxy, MOE, and cEt | 27 | 9326 | 9341 | 4247 |
| 562387 | N/A | N/A | AAAGTCTGATTATCCT | Deoxy, MOE, and cEt | 90 | 9332 | 9347 | 152 |
| 562388 | N/A | N/A | TAACTGAAAGTCTGAT | Deoxy, MOE, and cEt | 59 | 9338 | 9353 | 4248 |
| 562389 | N/A | N/A | GTGCACAAAAATGTTA | Deoxy, MOE, and cEt | 42 | 9366 | 9381 | 4249 |
| 562390 | N/A | N/A | AGCTATGTGCACAAAA | Deoxy, MOE, and cEt | 77 | 9372 | 9387 | 4250 |
| 562391 | N/A | N/A | GAAGATAGCTATGTGC | Deoxy, MOE, and cEt | 64 | 9378 | 9393 | 4251 |
| 562392 | N/A | N/A | TTTATTGAAGATAGCT | Deoxy, MOE, and cEt | 33 | 9384 | 9399 | 4252 |
| 562393 | N/A | N/A | TCATTTAGTGTATCT | Deoxy, MOE, and cEt | 40 | 9424 | 9439 | 4253 |
| 562394 | N/A | N/A | CCTTGATCATTTTAGT | Deoxy, MOE, and cEt | 15 | 9430 | 9445 | 4254 |
| 562395 | N/A | N/A | TGAATCCCTTGATCAT | Deoxy, MOE, and cEt | 59 | 9436 | 9451 | 4255 |
| 562396 | N/A | N/A | TAGTCTTGAATCCCTT | Deoxy, MOE, and cEt | 83 | 9442 | 9457 | 153 |
| 562397 | N/A | N/A | GTTGTTAGTCTTGAA | Deoxy, MOE, and cEt | 65 | 9448 | 9463 | 4256 |
| 562398 | N/A | N/A | AATTGAGTTGTTTAGT | Deoxy, MOE, and cEt | 21 | 9454 | 9469 | 4257 |
| 562399 | N/A | N/A | GCAACTAATTGAGTTG | Deoxy, MOE, and cEt | 15 | 9460 | 9475 | 4258 |
| 562400 | N/A | N/A | ATTGGTGCAACTAATT | Deoxy, MOE, and cEt | 25 | 9466 | 9481 | 4259 |
| 562401 | N/A | N/A | GTTTTTTATTGGTGCA | Deoxy, MOE, and cEt | 53 | 9473 | 9488 | 4260 |
| 562402 | N/A | N/A | GGACACTGACAGTTTT | Deoxy, MOE, and cEt | 43 | 9496 | 9511 | 4261 |
| 562403 | N/A | N/A | CAGGTTGGACACTGAC | Deoxy, MOE, and cEt | 23 | 9502 | 9517 | 4262 |
| 562404 | N/A | N/A | TAAGTACAGGTTGGAC | Deoxy, MOE, and cEt | 33 | 9508 | 9523 | 4263 |
| 562405 | N/A | N/A | AGTTATTAAGTACAGG | Deoxy, MOE, and cEt | 34 | 9514 | 9529 | 4264 |
| 562406 | N/A | N/A | TCTGTGAGTTATTAAG | Deoxy, MOE, and cEt | 10 | 9520 | 9535 | 4265 |
| 562407 | N/A | N/A | ACCAAAATTCTCCTGA | Deoxy, MOE, and cEt | 1 | 9554 | 9569 | 4266 |
| 562408 | N/A | N/A | ACCTGAATAACCCTCT | Deoxy, MOE, and cEt | 73 | 9811 | 9826 | 4267 |
| 562409 | N/A | N/A | GGTATCAGAAAAAGAT | Deoxy, MOE, and cEt | 14 | 9827 | 9842 | 4268 |
| 562410 | N/A | N/A | AGTATTGGTATCAGAA | Deoxy, MOE, and cEt | 13 | 9833 | 9848 | 4269 |
| 562411 | N/A | N/A | GGAAGATACTTTGAAG | Deoxy, MOE, and cEt | 25 | 9861 | 9876 | 4270 |
| 562412 | N/A | N/A | AATGTGGGAAGATACT | Deoxy, MOE, and cEt | 23 | 9867 | 9882 | 4271 |
| 562413 | N/A | N/A | CAGATAATAGCTAATA | Deoxy, MOE, and cEt | 29 | 9882 | 9897 | 4272 |
| 562414 | N/A | N/A | TCATTGCAGATAATAG | Deoxy, MOE, and cEt | 45 | 9888 | 9903 | 4273 |
| 562415 | N/A | N/A | AAGTTGTCATTGCAGA | Deoxy, MOE, and cEt | 86 | 9894 | 9909 | 154 |
| 562416 | N/A | N/A | GATTCGGATTTTAAA | Deoxy, MOE, and cEt | 19 | 9909 | 9924 | 4274 |

TABLE 153-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562417 | N/A | N/A | ATTTGGGATTCGGATT | Deoxy, MOE, and cEt | 34 | 9915 | 9930 | 4275 |
| 562418 | N/A | N/A | ACGCTTATTTGGGATT | Deoxy, MOE, and cEt | 64 | 9921 | 9936 | 4276 |
| 562419 | N/A | N/A | TCTAGAGAGAAAACGC | Deoxy, MOE, and cEt | 64 | 9933 | 9948 | 4277 |
| 562420 | N/A | N/A | AGTTAAGAGGTTTTCG | Deoxy, MOE, and cEt | 34 | 9949 | 9964 | 4278 |
| 562421 | N/A | N/A | CATTATAGTTAAGAGG | Deoxy, MOE, and cEt | 24 | 9955 | 9970 | 4279 |
| 562422 | N/A | N/A | CACTTTCATTATAGTT | Deoxy, MOE, and cEt | 13 | 9961 | 9976 | 4280 |
| 562423 | N/A | N/A | TAGAATGAACACTTTC | Deoxy, MOE, and cEt | 63 | 9970 | 9985 | 4281 |
| 562424 | N/A | N/A | TTGAACTAGAATGAAC | Deoxy, MOE, and cEt | 16 | 9976 | 9991 | 4282 |
| 562425 | N/A | N/A | ACCTGATTGAACTAGA | Deoxy, MOE, and cEt | 51 | 9982 | 9997 | 4283 |
| 562426 | N/A | N/A | TAAAATACCTGATTGA | Deoxy, MOE, and cEt | 19 | 9988 | 10003 | 4284 |
| 562427 | N/A | N/A | TAGAGGTAAAATACCT | Deoxy, MOE, and cEt | 12 | 9994 | 10009 | 4285 |
| 562428 | N/A | N/A | GAAGATTAGAGGTAAA | Deoxy, MOE, and cEt | 1 | 10000 | 10015 | 4286 |
| 562429 | N/A | N/A | TCTGAGGAAGATTAGA | Deoxy, MOE, and cEt | 31 | 10006 | 10021 | 4287 |
| 562430 | N/A | N/A | TATACACTACCAAAAA | Deoxy, MOE, and cEt | 0 | 10030 | 10045 | 4288 |
| 562431 | N/A | N/A | ATAATCTATACACTAC | Deoxy, MOE, and cEt | 0 | 10036 | 10051 | 4289 |
| 562432 | N/A | N/A | TAAGTCCCAATTTTAA | Deoxy, MOE, and cEt | 33 | 10065 | 10080 | 4290 |
| 562433 | N/A | N/A | TCTGTATAAGTCCCAA | Deoxy, MOE, and cEt | 89 | 10071 | 10086 | 155 |
| 562434 | N/A | N/A | CCAGTTTTAAATAATC | Deoxy, MOE, and cEt | 20 | 10085 | 10100 | 4291 |
| 562435 | N/A | N/A | TGTATCCCAGTTTTAA | Deoxy, MOE, and cEt | 44 | 10091 | 10106 | 4292 |
| 562436 | N/A | N/A | GATGCATGTATCCCAG | Deoxy, MOE, and cEt | 91 | 10097 | 10112 | 156 |
| 562437 | N/A | N/A | GTTTTAGATGCATGTA | Deoxy, MOE, and cEt | 69 | 10103 | 10118 | 4293 |
| 562438 | N/A | N/A | TACAGTGTTTTAGATG | Deoxy, MOE, and cEt | 28 | 10109 | 10124 | 4294 |
| 562439 | N/A | N/A | GTAAGTTTATCTTCCT | Deoxy, MOE, and cEt | 78 | 10138 | 10153 | 157 |
| 562440 | N/A | N/A | TTCCCCGTAAGTTTAT | Deoxy, MOE, and cEt | 33 | 10144 | 10159 | 4295 |
| 562441 | N/A | N/A | CTGTATTTCCCCGTAA | Deoxy, MOE, and cEt | 55 | 10150 | 10165 | 4296 |
| 562442 | N/A | N/A | CTGTTACTGTATTTCC | Deoxy, MOE, and cEt | 79 | 10156 | 10171 | 158 |
| 562443 | N/A | N/A | TAGTTACTGTTACTGT | Deoxy, MOE, and cEt | 70 | 10162 | 10177 | 4297 |
| 562444 | N/A | N/A | CGTATGTAGTTACTGT | Deoxy, MOE, and cEt | 66 | 10168 | 10183 | 4298 |
| 562445 | N/A | N/A | AATGGGTACAGACTCG | Deoxy, MOE, and cEt | 72 | 10182 | 10197 | 4299 |
| 562446 | N/A | N/A | GCAATTTAATGGGTAC | Deoxy, MOE, and cEt | 59 | 10189 | 10204 | 4300 |
| 562447 | N/A | N/A | GATAGATATGCAATTT | Deoxy, MOE, and cEt | 20 | 10198 | 10213 | 4301 |
| 562448 | N/A | N/A | AAAGGAGATAGATATG | Deoxy, MOE, and cEt | 22 | 10204 | 10219 | 4302 |
| 562449 | N/A | N/A | CCTCCTAAAGGAGATA | Deoxy, MOE, and cEt | 42 | 10210 | 10225 | 4303 |
| 562450 | N/A | N/A | CACCAGCCTCCTAAAG | Deoxy, MOE, and cEt | 37 | 10216 | 10231 | 4304 |
| 544120 | 707 | 726 | AGTTCTTGGTGCTCTTGGCT | 5-10-5 MOE | 83 | 6720 | 6739 | 15 |
| 560990 | 709 | 724 | TTCTTGGTGCTCTTGG | Deoxy, MOE, and cEt | 89 | 6722 | 6737 | 111 |
| 337487 | 804 | 823 | CACTTGTATGTTCACCTCTG | 5-10-5 MOE | 81 | 7389 | 7408 | 28 |
| 561373 | 1197 | 1212 | TTTGTGATCCCAAGTA | Deoxy, MOE, and cEt | 40 | 9772 | 9787 | 4305 |
| 561374 | 1199 | 1214 | GCTTTGTGATCCCAAG | Deoxy, MOE, and cEt | 76 | 9774 | 9789 | 4306 |
| 561375 | 1201 | 1216 | TTGCTTTGTGATCCCA | Deoxy, MOE, and cEt | 82 | 9776 | 9791 | 4307 |
| 561376 | 1203 | 1218 | TTTTGCTTTGTGATCC | Deoxy, MOE, and cEt | 40 | 9778 | 9793 | 4308 |
| 561377 | 1205 | 1220 | CCTTTTGCTTTGTGAT | Deoxy, MOE, and cEt | 38 | 9780 | 9795 | 4309 |
| 561378 | 1207 | 1222 | GTCCTTTTGCTTTGTG | Deoxy, MOE, and cEt | 75 | 9782 | 9797 | 4310 |
| 561379 | 1209 | 1224 | GTGTCCTTTTGCTTTG | Deoxy, MOE, and cEt | 40 | 9784 | 9799 | 4311 |
| 561380 | 1212 | 1227 | GAAGTGTCCTTTTGCT | Deoxy, MOE, and cEt | 23 | 9787 | 9802 | 4312 |
| 561381 | 1214 | 1229 | TTGAAGTGTCCTTTTG | Deoxy, MOE, and cEt | 26 | 9789 | 9804 | 4313 |
| 561382 | 1216 | 1231 | AGTTGAAGTGTCCTTT | Deoxy, MOE, and cEt | 34 | 9791 | 9806 | 4314 |
| 561383 | 1218 | 1233 | ACAGTTGAAGTGTCCT | Deoxy, MOE, and cEt | 27 | 9793 | 9808 | 4315 |
| 561384 | 1220 | 1235 | GGACAGTTGAAGTGTC | Deoxy, MOE, and cEt | 19 | 9795 | 9810 | 4316 |
| 561385 | 1222 | 1237 | CTGGACAGTTGAAGTG | Deoxy, MOE, and cEt | 34 | 9797 | 9812 | 4317 |
| 561386 | 1224 | 1239 | CTCTGGACAGTTGAAG | Deoxy, MOE, and cEt | 19 | 9799 | 9814 | 4318 |
| 561387 | 1226 | 1241 | CCCTCTGGACAGTTGA | Deoxy, MOE, and cEt | 54 | 9801 | 9816 | 4319 |
| 561388 | 1228 | 1243 | AACCCTCTGGACAGTT | Deoxy, MOE, and cEt | 50 | 9803 | 9818 | 4320 |
| 561389 | 1230 | 1245 | ATAACCCTCTGGACAG | Deoxy, MOE, and cEt | 35 | 9805 | 9820 | 4321 |
| 561390 | 1232 | 1247 | GAATAACCCTCTGGAC | Deoxy, MOE, and cEt | 34 | 9807 | 9822 | 4322 |
| 561391 | 1234 | 1249 | CTGAATAACCCTCTGG | Deoxy, MOE, and cEt | 62 | 9809 | 9824 | 4323 |
| 561392 | 1236 | 1251 | TCCTGAATAACCCTCT | Deoxy, MOE, and cEt | 57 | N/A | N/A | 4324 |
| 561393 | 1238 | 1253 | CCTCCTGAATAACCCT | Deoxy, MOE, and cEt | 30 | N/A | N/A | 4325 |
| 561394 | 1246 | 1261 | ACCACCAGCCTCCTGA | Deoxy, MOE, and cEt | 70 | N/A | N/A | 4326 |
| 561395 | 1251 | 1266 | ATGCCACCACCAGCCT | Deoxy, MOE, and cEt | 68 | 10223 | 10238 | 4327 |
| 561396 | 1253 | 1268 | TCATGCCACCACCAGC | Deoxy, MOE, and cEt | 72 | 10225 | 10240 | 4328 |
| 561397 | 1255 | 1270 | CATCATGCCACCACCA | Deoxy, MOE, and cEt | 67 | 10227 | 10242 | 4329 |
| 561398 | 1257 | 1272 | CTCATCATGCCACCAC | Deoxy, MOE, and cEt | 77 | 10229 | 10244 | 172 |
| 561399 | 1259 | 1274 | CACTCATCATGCCACC | Deoxy, MOE, and cEt | 74 | 10231 | 10246 | 2330 |
| 561400 | 1261 | 1276 | CACACTCATCATGCCA | Deoxy, MOE, and cEt | 80 | 10233 | 10248 | 173 |
| 561401 | 1263 | 1278 | TCCACACTCATCATGC | Deoxy, MOE, and cEt | 64 | 10235 | 10250 | 4331 |
| 561402 | 1265 | 1280 | TCTCCACACTCATCAT | Deoxy, MOE, and cEt | 42 | 10237 | 10252 | 4332 |
| 561403 | 1267 | 1282 | TTTCTCCACACTCATC | Deoxy, MOE, and cEt | 47 | 10239 | 10254 | 4333 |
| 561404 | 1269 | 1284 | GTTTTCTCCACACTCA | Deoxy, MOE, and cEt | 77 | 10241 | 10256 | 4334 |
| 561405 | 1272 | 1287 | GTTGTTTTCTCCACAC | Deoxy, MOE, and cEt | 53 | 10244 | 10259 | 4335 |
| 561406 | 1274 | 1289 | AGGTTGTTTTCTCCAC | Deoxy, MOE, and cEt | 67 | 10246 | 10261 | 4336 |
| 561407 | 1276 | 1291 | TTAGGTTGTTTTCTCC | Deoxy, MOE, and cEt | 73 | 10248 | 10263 | 4337 |
| 561408 | 1282 | 1297 | TACCATTAGGTTGTT | Deoxy, MOE, and cEt | 30 | 10254 | 10269 | 4338 |

TABLE 153-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561409 | 1284 | 1299 | TTTACCATTTAGGTTG | Deoxy, MOE, and cEt | 22 | 10256 | 10271 | 4339 |
| 561410 | 1286 | 1301 | TATTTACCATTTAGGT | Deoxy, MOE, and cEt | 24 | 10258 | 10273 | 4340 |
| 561411 | 1292 | 1307 | TTGTTATATTTACCAT | Deoxy, MOE, and cEt | 41 | 10264 | 10279 | 4341 |
| 561412 | 1294 | 1309 | GTTTGTTATATTTACC | Deoxy, MOE, and cEt | 37 | 10266 | 10281 | 4342 |
| 561413 | 1298 | 1313 | CTTGGTTTGTTATATT | Deoxy, MOE, and cEt | 45 | 10270 | 10285 | 4343 |
| 561414 | 1300 | 1315 | CTCTTGGTTTGTTATA | Deoxy, MOE, and cEt | 73 | 10272 | 10287 | 4344 |
| 561415 | 1302 | 1317 | TGCTCTTGGTTTGTTA | Deoxy, MOE, and cEt | 45 | 10274 | 10289 | 4345 |
| 561416 | 1304 | 1319 | TTTGCTCTTGGTTTGT | Deoxy, MOE, and cEt | 67 | 10276 | 10291 | 4346 |
| 561417 | 1307 | 1322 | GATTTTGCTCTTGGTT | Deoxy, MOE, and cEt | 75 | 10279 | 10294 | 4347 |
| 561418 | 1309 | 1324 | TAGATTTTGCTCTTGG | Deoxy, MOE, and cEt | 87 | 10281 | 10296 | 169 |
| 561419 | 1311 | 1326 | CTTAGATTTTGCTCTT | Deoxy, MOE, and cEt | 64 | 10283 | 10298 | 4348 |
| 561420 | 1313 | 1328 | GGCTTAGATTTTGCTC | Deoxy, MOE, and cEt | 58 | 10285 | 10300 | 4349 |
| 561421 | 1315 | 1330 | CTGGCTTAGATTTTGC | Deoxy, MOE, and cEt | 70 | 10287 | 10302 | 4350 |
| 561422 | 1317 | 1332 | CTCTGGCTTAGATTTT | Deoxy, MOE, and cEt | 38 | 10289 | 10304 | 4351 |
| 561423 | 1319 | 1334 | CTCTCTGGCTTAGATT | Deoxy, MOE, and cEt | 63 | 10291 | 10306 | 4352 |
| 561424 | 1321 | 1336 | TCCTCTCTGGCTTAGA | Deoxy, MOE, and cEt | 76 | 10293 | 10308 | 4353 |
| 561425 | 1323 | 1338 | TCTCCTCTCTGGCTTA | Deoxy, MOE, and cEt | 67 | 10295 | 10310 | 4354 |
| 561426 | 1332 | 1347 | TAATCCTCTTCTCCTC | Deoxy, MOE, and cEt | 50 | 10304 | 10319 | 4355 |
| 561427 | 1334 | 1349 | GATAATCCTCTTCTCC | Deoxy, MOE, and cEt | 36 | 10306 | 10321 | 4356 |
| 561428 | 1336 | 1351 | AAGATAATCCTCTTCT | Deoxy, MOE, and cEt | 43 | 10308 | 10323 | 4357 |
| 561429 | 1338 | 1353 | CCAAGATAATCCTCTT | Deoxy, MOE, and cEt | 59 | 10310 | 10325 | 4358 |
| 561430 | 1340 | 1355 | TTCCAAGATAATCCTC | Deoxy, MOE, and cEt | 65 | 10312 | 10327 | 4359 |
| 561431 | 1342 | 1357 | ACTTCCAAGATAATCC | Deoxy, MOE, and cEt | 74 | 10314 | 10329 | 4360 |
| 561432 | 1344 | 1359 | AGACTTCCAAGATAAT | Deoxy, MOE, and cEt | 52 | 10316 | 10331 | 4361 |
| 561433 | 1346 | 1361 | TGAGACTTCCAAGATA | Deoxy, MOE, and cEt | 49 | 10318 | 10333 | 4362 |
| 561434 | 1348 | 1363 | TTTGAGACTTCCAAGA | Deoxy, MOE, and cEt | 47 | 10320 | 10335 | 4363 |
| 561435 | 1350 | 1365 | ATTTTGAGACTTCCAA | Deoxy, MOE, and cEt | 64 | 10322 | 10337 | 4364 |
| 561436 | 1352 | 1367 | CCATTTTGAGACTTCC | Deoxy, MOE, and cEt | 84 | 10324 | 10339 | 170 |
| 561437 | 1354 | 1369 | TTCCATTTTGAGACTT | Deoxy, MOE, and cEt | 67 | 10326 | 10341 | 4365 |
| 561438 | 1356 | 1371 | CCTTCCATTTTGAGAC | Deoxy, MOE, and cEt | 53 | 10328 | 10343 | 4366 |
| 561439 | 1358 | 1373 | AACCTTCCATTTTGAG | Deoxy, MOE, and cEt | 37 | 10330 | 10345 | 4367 |
| 561440 | 1360 | 1375 | ATAACCTTCCATTTTG | Deoxy, MOE, and cEt | 50 | 10332 | 10347 | 4368 |
| 561441 | 1362 | 1377 | GTATAACCTTCCATTT | Deoxy, MOE, and cEt | 27 | 10334 | 10349 | 4369 |
| 561442 | 1364 | 1379 | GAGTATAACCTTCCAT | Deoxy, MOE, and cEt | 65 | 10336 | 10351 | 4370 |
| 561443 | 1366 | 1381 | TAGAGTATAACCTTCC | Deoxy, MOE, and cEt | 84 | 10338 | 10353 | 171 |
| 561444 | 1368 | 1383 | TATAGAGTATAACCTT | Deoxy, MOE, and cEt | 17 | 10340 | 10355 | 4371 |
| 561445 | 1370 | 1385 | TTTATAGAGTATAACC | Deoxy, MOE, and cEt | 37 | 10342 | 10357 | 4372 |
| 561446 | 1373 | 1388 | GATTTTATAGAGTATA | Deoxy, MOE, and cEt | 28 | 10345 | 10360 | 4373 |
| 561447 | 1375 | 1390 | TTGATTTTATAGAGTA | Deoxy, MOE, and cEt | 21 | 10347 | 10362 | 4374 |
| 561448 | 1377 | 1392 | GGTTGATTTTATAGAG | Deoxy, MOE, and cEt | 28 | 10349 | 10364 | 4375 |
| 561449 | 1379 | 1394 | TTGGTTGATTTTATAG | Deoxy, MOE, and cEt | 22 | 10351 | 10366 | 4376 |
| 567295 | 1452 | 1471 | TAATGTTTAAATTATTGCCT | 5-10-5 MOE | 43 | 10424 | 10443 | 4377 |
| 567296 | 1455 | 1474 | GGTTAATGTTTAAATTATTG | 5-10-5 MOE | 22 | 10427 | 10446 | 4378 |
| 567297 | 1456 | 1475 | AGGTTAATGTTTAAATTATT | 5-10-5 MOE | 0 | 10428 | 10447 | 4379 |
| 567298 | 1457 | 1476 | GAGGTTAATGTTTAAATTAT | 5-10-5 MOE | 0 | 10429 | 10448 | 4380 |
| 567299 | 1458 | 1477 | TGAGGTTAATGTTTAAATTA | 5-10-5 MOE | 6 | 10430 | 10449 | 4381 |
| 567300 | 1460 | 1479 | AATGAGGTTAATGTTTAAAT | 5-10-5 MOE | 14 | 10432 | 10451 | 4382 |
| 567301 | 1461 | 1480 | GAATGAGGTTAATGTTTAAA | 5-10-5 MOE | 5 | 10433 | 10452 | 4383 |
| 567302 | 1462 | 1481 | GGAATGAGGTTAATGTTTAA | 5-10-5 MOE | 27 | 10434 | 10453 | 4384 |
| 567303 | 1463 | 1482 | TGGAATGAGGTTAATGTTTA | 5-10-5 MOE | 32 | 10435 | 10454 | 4385 |
| 567304 | 1464 | 1483 | TTGGAATGAGGTTAATGTTT | 5-10-5 MOE | 37 | 10436 | 10455 | 4386 |
| 567305 | 1465 | 1484 | CTTGGAATGAGGTTAATGTT | 5-10-5 MOE | 25 | 10437 | 10456 | 4387 |
| 567306 | 1468 | 1487 | TAACTTGGAATGAGGTTAAT | 5-10-5 MOE | 29 | 10440 | 10459 | 4388 |
| 567307 | 1469 | 1488 | TTAACTTGGAATGAGGTTAA | 5-10-5 MOE | 44 | 10441 | 10460 | 4389 |
| 337513 | 1470 | 1489 | ATTAACTTGGAATGAGGTTA | 5-10-5 MOE | 52 | 10442 | 10461 | 4390 |
| 567308 | 1471 | 1490 | CATTAACTTGGAATGAGGTT | 5-10-5 MOE | 62 | 10443 | 10462 | 4391 |
| 567309 | 1472 | 1491 | ACATTAACTTGGAATGAGGT | 5-10-5 MOE | 58 | 10444 | 10463 | 4392 |
| 567310 | 1473 | 1492 | CACATTAACTTGGAATGAGG | 5-10-5 MOE | 78 | 10445 | 10464 | 92 |
| 567311 | 1475 | 1494 | ACCACATTAACTTGGAATGA | 5-10-5 MOE | 59 | 10447 | 10466 | 4393 |
| 567312 | 1476 | 1495 | GACCACATTAACTTGGAATG | 5-10-5 MOE | 57 | 10448 | 10467 | 4394 |
| 337514 | 1477 | 1496 | AGACCACATTAACTTGGAAT | 5-10-5 MOE | 71 | 10449 | 10468 | 4395 |
| 567313 | 1478 | 1497 | TAGACCACATTAACTTGGAA | 5-10-5 MOE | 43 | 10450 | 10469 | 4396 |
| 567314 | 1479 | 1498 | TTAGACCACATTAACTTGGA | 5-10-5 MOE | 59 | 10451 | 10470 | 4397 |
| 567315 | 1480 | 1499 | ATTAGACCACATTAACTTGG | 5-10-5 MOE | 70 | 10452 | 10471 | 4398 |
| 567316 | 1481 | 1500 | TATTAGACCACATTAACTTG | 5-10-5 MOE | 53 | 10453 | 10472 | 4399 |
| 567317 | 1482 | 1501 | TTATTAGACCACATTAACTT | 5-10-5 MOE | 49 | 10454 | 10473 | 4400 |
| 567318 | 1483 | 1502 | ATTATTAGACCACATTAACT | 5-10-5 MOE | 41 | 10455 | 10474 | 4401 |
| 567319 | 1484 | 1503 | GATTATTAGACCACATTAAC | 5-10-5 MOE | 47 | 10456 | 10475 | 4402 |
| 567320 | 1487 | 1506 | CCAGATTATTAGACCACATT | 5-10-5 MOE | 86 | 10459 | 10478 | 93 |
| 567321 | 1489 | 1508 | TACCAGATTATTAGACCACA | 5-10-5 MOE | 85 | 10461 | 10480 | 94 |
| 337516 | 1490 | 1509 | ATACCAGATTATTAGACCAC | 5-10-5 MOE | 77 | 10462 | 10481 | 86 |
| 567322 | 1491 | 1510 | AATACCAGATTATTAGACCA | 5-10-5 MOE | 50 | 10463 | 10482 | 4403 |
| 567323 | 1492 | 1511 | TAATACCAGATTATTAGACC | 5-10-5 MOE | 56 | 10464 | 10483 | 4404 |

TABLE 153-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 567324 | 1494 | 1513 | TTTAATACCAGATTATTAGA | 5-10-5 MOE | 9 | 10466 | 10485 | 4405 |
| 567325 | 1495 | 1514 | ATTTAATACCAGATTATTAG | 5-10-5 MOE | 24 | 10467 | 10486 | 4406 |
| 567326 | 1496 | 1515 | GATTTAATACCAGATTATTA | 5-10-5 MOE | 37 | 10468 | 10487 | 4407 |
| 567327 | 1500 | 1519 | TAAGGATTTAATACCAGATT | 5-10-5 MOE | 60 | 10472 | 10491 | 4408 |
| 567328 | 1507 | 1526 | TTTCTCTTAAGGATTTAATA | 5-10-5 MOE | 34 | 10479 | 10498 | 4409 |
| 567329 | 1508 | 1527 | CTTTCTCTTAAGGATTTAAT | 5-10-5 MOE | 46 | 10480 | 10499 | 4410 |
| 567330 | 1509 | 1528 | GCTTTCTCTTAAGGATTTAA | 5-10-5 MOE | 75 | 10481 | 10500 | 95 |
| 567331 | 1510 | 1529 | AGCTTTCTCTTAAGGATTTA | 5-10-5 MOE | 59 | 10482 | 10501 | 4411 |
| 567332 | 1511 | 1530 | AAGCTTTCTCTTAAGGATTT | 5-10-5 MOE | 30 | 10483 | 10502 | 4412 |
| 567333 | 1513 | 1532 | TCAAGCTTTCTCTTAAGGAT | 5-10-5 MOE | 65 | 10485 | 10504 | 4413 |
| 567334 | 1514 | 1533 | CTCAAGCTTTCTCTTAAGGA | 5-10-5 MOE | 77 | 10486 | 10505 | 96 |
| 567335 | 1515 | 1534 | TCTCAAGCTTTCTCTTAAGG | 5-10-5 MOE | 75 | 10487 | 10506 | 97 |
| 567336 | 1516 | 1535 | TTCTCAAGCTTTCTCTTAAG | 5-10-5 MOE | 59 | 10488 | 10507 | 4414 |
| 567337 | 1517 | 1536 | TTTCTCAAGCTTTCTCTTAA | 5-10-5 MOE | 52 | 10489 | 10508 | 4415 |
| 567338 | 1521 | 1540 | TCTATTTCTCAAGCTTTCTC | 5-10-5 MOE | 68 | 10493 | 10512 | 4416 |
| 567339 | 1522 | 1541 | ATCTATTTCTCAAGCTTTCT | 5-10-5 MOE | 71 | 10494 | 10513 | 4417 |
| 567340 | 1523 | 1542 | AATCTATTTCTCAAGCTTTC | 5-10-5 MOE | 74 | 10495 | 10514 | 4418 |
| 567341 | 1524 | 1543 | AAATCTATTTCTCAAGCTTT | 5-10-5 MOE | 63 | 10496 | 10515 | 4419 |
| 567342 | 1525 | 1544 | AAAATCTATTTCTCAAGCTT | 5-10-5 MOE | 54 | 10497 | 10516 | 4420 |
| 567343 | 1532 | 1551 | GATAAAAAAATCTATTTCT | 5-10-5 MOE | 30 | 10504 | 10523 | 4421 |
| 567344 | 1548 | 1567 | TAGACAGTGACTTTAAGATA | 5-10-5 MOE | 37 | 10520 | 10539 | 4422 |
| 567345 | 1549 | 1568 | ATAGACAGTGACTTTAAGAT | 5-10-5 MOE | 29 | 10521 | 10540 | 4423 |
| 567346 | 1550 | 1569 | AATAGACAGTGACTTTAAGA | 5-10-5 MOE | 48 | 10522 | 10541 | 4424 |
| 567347 | 1551 | 1570 | AAATAGACAGTGACTTTAAG | 5-10-5 MOE | 26 | 10523 | 10542 | 4425 |
| 567348 | 1552 | 1571 | TAAATAGACAGTGACTTTAA | 5-10-5 MOE | 26 | 10524 | 10543 | 4426 |
| 567349 | 1553 | 1572 | TTAAATAGACAGTGACTTTA | 5-10-5 MOE | 50 | 10525 | 10544 | 4427 |
| 567350 | 1554 | 1573 | CTTAAATAGACAGTGACTTT | 5-10-5 MOE | 63 | 10526 | 10545 | 4428 |
| 567351 | 1555 | 1574 | TCTTAAATAGACAGTGACTT | 5-10-5 MOE | 57 | 10527 | 10546 | 4429 |
| 567352 | 1556 | 1575 | ATCTTAAATAGACAGTGACT | 5-10-5 MOE | 69 | 10528 | 10547 | 4430 |
| 567353 | 1557 | 1576 | AATCTTAAATAGACAGTGAC | 5-10-5 MOE | 40 | 10529 | 10548 | 4431 |
| 567354 | 1558 | 1577 | TAATCTTAAATAGACAGTGA | 5-10-5 MOE | 30 | 10530 | 10549 | 4432 |
| 567355 | 1559 | 1578 | TTAATCTTAAATAGACAGTG | 5-10-5 MOE | 25 | 10531 | 10550 | 4433 |
| 567356 | 1560 | 1579 | TTTAATCTTAAATAGACAGT | 5-10-5 MOE | 0 | 10532 | 10551 | 4434 |
| 567357 | 1561 | 1580 | GTTTAATCTTAAATAGACAG | 5-10-5 MOE | 34 | 10533 | 10552 | 4435 |
| 567358 | 1562 | 1581 | TGTTTAATCTTAAATAGACA | 5-10-5 MOE | 5 | 10534 | 10553 | 4436 |
| 567359 | 1563 | 1582 | ATGTTTAATCTTAAATAGAC | 5-10-5 MOE | 0 | 10535 | 10554 | 4437 |
| 567360 | 1567 | 1586 | TTGTATGTTTAATCTTAAAT | 5-10-5 MOE | 0 | 10539 | 10558 | 4438 |
| 567361 | 1568 | 1587 | ATTGTATGTTTAATCTTAAA | 5-10-5 MOE | 8 | 10540 | 10559 | 4439 |
| 567362 | 1569 | 1588 | GATTGTATGTTTAATCTTAA | 5-10-5 MOE | 20 | 10541 | 10560 | 4440 |
| 567363 | 1570 | 1589 | TGATTGTATGTTTAATCTTA | 5-10-5 MOE | 29 | 10542 | 10561 | 4441 |
| 567364 | 1574 | 1593 | TATGTGATTGTATGTTTAAT | 5-10-5 MOE | 7 | 10546 | 10565 | 4442 |
| 567365 | 1576 | 1595 | GTTATGTGATTGTATGTTTA | 5-10-5 MOE | 43 | 10548 | 10567 | 4443 |
| 567366 | 1580 | 1599 | TAAGGTTATGTGATTGTATG | 5-10-5 MOE | 28 | 10552 | 10571 | 4444 |
| 567367 | 1581 | 1600 | TTAAGGTTATGTGATTGTAT | 5-10-5 MOE | 31 | 10553 | 10572 | 4445 |
| 567368 | 1585 | 1604 | TTCTTTAAGGTTATGTGATT | 5-10-5 MOE | 12 | 10557 | 10576 | 4446 |
| 561527 | 1604 | 1619 | GAAATGTAAACGGTAT | Deoxy, MOE, and cEt | 47 | 10576 | 10591 | 4447 |
| 561528 | 1606 | 1621 | GAGAAATGTAAACGGT | Deoxy, MOE, and cEt | 89 | 10578 | 10593 | 174 |
| 561529 | 1608 | 1623 | TTGAGAAATGTAAACG | Deoxy, MOE, and cEt | 55 | 10580 | 10595 | 4448 |
| 561530 | 1611 | 1626 | TGATTGAGAAATGTAA | Deoxy, MOE, and cEt | 18 | 10583 | 10598 | 4449 |
| 561531 | 1613 | 1628 | TTTGATTGAGAAATGT | Deoxy, MOE, and cEt | 30 | 10585 | 10600 | 4450 |
| 561532 | 1619 | 1634 | AAGAATTTTGATTGAG | Deoxy, MOE, and cEt | 53 | 10591 | 10606 | 4451 |
| 561533 | 1621 | 1636 | ATAAGAATTTTGATTG | Deoxy, MOE, and cEt | 29 | 10593 | 10608 | 4452 |
| 561534 | 1632 | 1647 | CAAATAGTATTATAAG | Deoxy, MOE, and cEt | 6 | 10604 | 10619 | 4453 |
| 561535 | 1653 | 1668 | CCCACATCACAAAATT | Deoxy, MOE, and cEt | 70 | 10625 | 10640 | 4454 |
| 561536 | 1657 | 1672 | GATTCCCACATCACAA | Deoxy, MOE, and cEt | 77 | 10629 | 10644 | 4455 |
| 561537 | 1659 | 1674 | TTGATTCCCACATCAC | Deoxy, MOE, and cEt | 78 | 10631 | 10646 | 4456 |
| 561538 | 1661 | 1676 | AATTGATTCCCACATC | Deoxy, MOE, and cEt | 68 | 10633 | 10648 | 4457 |
| 561539 | 1663 | 1678 | AAAATTGATTCCCACA | Deoxy, MOE, and cEt | 72 | 10635 | 10650 | 4458 |
| 561540 | 1665 | 1680 | CTAAAATTGATTCCCA | Deoxy, MOE, and cEt | 54 | 10637 | 10652 | 4459 |
| 561541 | 1668 | 1683 | CATCTAAAATTGATTC | Deoxy, MOE, and cEt | 0 | 10640 | 10655 | 4460 |
| 561542 | 1670 | 1685 | ACCATCTAAAATTGAT | Deoxy, MOE, and cEt | 35 | 10642 | 10657 | 4461 |
| 561543 | 1672 | 1687 | TGACCATCTAAAATTG | Deoxy, MOE, and cEt | 55 | 10644 | 10659 | 4462 |
| 561544 | 1674 | 1689 | TGTGACCATCTAAAAT | Deoxy, MOE, and cEt | 56 | 10646 | 10661 | 4463 |
| 561545 | 1676 | 1691 | ATTGTGACCATCTAAA | Deoxy, MOE, and cEt | 73 | 10648 | 10663 | 4464 |
| 561546 | 1678 | 1693 | AGATTGTGACCATCTA | Deoxy, MOE, and cEt | 67 | 10650 | 10665 | 4465 |
| 561547 | 1680 | 1695 | CTAGATTGTGACCATC | Deoxy, MOE, and cEt | 50 | 10652 | 10667 | 4466 |
| 561548 | 1682 | 1697 | ATCTAGATTGTGACCA | Deoxy, MOE, and cEt | 77 | 10654 | 10669 | 4467 |
| 561549 | 1684 | 1699 | TAATCTAGATTGTGAC | Deoxy, MOE, and cEt | 55 | 10656 | 10671 | 4468 |
| 561550 | 1686 | 1701 | TATAATCTAGATTGTG | Deoxy, MOE, and cEt | 28 | 10658 | 10673 | 4469 |
| 561551 | 1688 | 1703 | ATTATAATCTAGATTG | Deoxy, MOE, and cEt | 52 | 10660 | 10675 | 4470 |
| 561552 | 1690 | 1705 | TGATTATAATCTAGAT | Deoxy, MOE, and cEt | 43 | 10662 | 10677 | 4471 |
| 561553 | 1692 | 1707 | ATTGATTATAATCTAG | Deoxy, MOE, and cEt | 53 | 10664 | 10679 | 4472 |
| 561554 | 1694 | 1709 | CTATTGATTATAATCT | Deoxy, MOE, and cEt | 54 | 10666 | 10681 | 4473 |

TABLE 153-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561555 | 1696 | 1711 | ACCTATTGATTATAAT | Deoxy, MOE, and cEt | 44 | 10668 | 10683 | 4474 |
| 561556 | 1698 | 1713 | TCACCTATTGATTATA | Deoxy, MOE, and cEt | 52 | 10670 | 10685 | 4475 |
| 561557 | 1700 | 1715 | GTTCACCTATTGATTA | Deoxy, MOE, and cEt | 50 | 10672 | 10687 | 4476 |
| 561558 | 1702 | 1717 | AAGTTCACCTATTGAT | Deoxy, MOE, and cEt | 58 | 10674 | 10689 | 4477 |
| 561559 | 1704 | 1719 | ATAAGTTCACCTATTG | Deoxy, MOE, and cEt | 66 | 10676 | 10691 | 4478 |
| 561560 | 1706 | 1721 | TAATAAGTTCACCTAT | Deoxy, MOE, and cEt | 38 | 10678 | 10693 | 4479 |
| 561561 | 1708 | 1723 | TTTAATAAGTTCACCT | Deoxy, MOE, and cEt | 50 | 10680 | 10695 | 4480 |
| 561562 | 1710 | 1725 | TATTTAATAAGTTCAC | Deoxy, MOE, and cEt | 32 | 10682 | 10697 | 4481 |
| 561563 | 1712 | 1727 | GTTATTTAATAAGTTC | Deoxy, MOE, and cEt | 47 | 10684 | 10699 | 4482 |
| 561564 | 1761 | 1776 | CATATGATGCCTTTTA | Deoxy, MOE, and cEt | 63 | 10733 | 10748 | 4483 |
| 561565 | 1763 | 1778 | CTCATATGATGCCTTT | Deoxy, MOE, and cEt | 81 | 10735 | 10750 | 175 |
| 561566 | 1765 | 1780 | AGCTCATATGATGCCT | Deoxy, MOE, and cEt | 81 | 10737 | 10752 | 176 |
| 561567 | 1767 | 1782 | TTAGCTCATATGATGC | Deoxy, MOE, and cEt | 84 | 10739 | 10754 | 177 |
| 561568 | 1769 | 1784 | TATTAGCTCATATGAT | Deoxy, MOE, and cEt | 46 | 10741 | 10756 | 4484 |
| 561569 | 1771 | 1786 | GATATTAGCTCATATG | Deoxy, MOE, and cEt | 49 | 10743 | 10758 | 4485 |
| 561570 | 1773 | 1788 | GTGATATTAGCTCATA | Deoxy, MOE, and cEt | 81 | 10745 | 10760 | 4486 |
| 561571 | 1775 | 1790 | TTGTGATATTAGCTCA | Deoxy, MOE, and cEt | 85 | 10747 | 10762 | 178 |
| 561572 | 1777 | 1792 | AGTTGTGATATTAGCT | Deoxy, MOE, and cEt | 68 | 10749 | 10764 | 4487 |
| 561573 | 1779 | 1794 | AAAGTTGTGATATTAG | Deoxy, MOE, and cEt | 45 | 10751 | 10766 | 4488 |
| 561574 | 1781 | 1796 | GGAAAGTTGTGATATT | Deoxy, MOE, and cEt | 27 | 10753 | 10768 | 4489 |
| 561575 | 1783 | 1798 | TGGGAAAGTTGTGATA | Deoxy, MOE, and cEt | 36 | 10755 | 10770 | 4490 |
| 561576 | 1785 | 1800 | ACTGGGAAAGTTGTGA | Deoxy, MOE, and cEt | 83 | 10757 | 10772 | 179 |
| 561577 | 1787 | 1802 | AAACTGGGAAAGTTGT | Deoxy, MOE, and cEt | 56 | 10759 | 10774 | 4491 |
| 561578 | 1789 | 1804 | TTAAACTGGGAAAGTT | Deoxy, MOE, and cEt | 44 | 10761 | 10776 | 4492 |
| 561579 | 1794 | 1809 | GTTTTTTAAACTGGGA | Deoxy, MOE, and cEt | 58 | 10766 | 10781 | 4493 |
| 561580 | 1796 | 1811 | TAGTTTTTTAAACTGG | Deoxy, MOE, and cEt | 0 | 10768 | 10783 | 4494 |
| 561581 | 1802 | 1817 | GAGTACTAGTTTTTTA | Deoxy, MOE, and cEt | 18 | 10774 | 10789 | 4495 |
| 561582 | 1804 | 1819 | AAGAGTACTAGTTTTT | Deoxy, MOE, and cEt | 55 | 10776 | 10791 | 4496 |
| 561583 | 1806 | 1821 | ACAAGAGTACTAGTTT | Deoxy, MOE, and cEt | 51 | 10778 | 10793 | 4497 |
| 561584 | 1808 | 1823 | TAACAAGAGTACTAGT | Deoxy, MOE, and cEt | 53 | 10780 | 10795 | 4498 |
| 561585 | 1810 | 1825 | TTTAACAAGAGTACTA | Deoxy, MOE, and cEt | 48 | 10782 | 10797 | 4499 |
| 561586 | 1812 | 1827 | GTTTTAACAAGAGTAC | Deoxy, MOE, and cEt | 49 | 10784 | 10799 | 4500 |
| 561587 | 1814 | 1829 | GAGTTTTAACAAGAGT | Deoxy, MOE, and cEt | 54 | 10786 | 10801 | 4501 |
| 561588 | 1816 | 1831 | TAGAGTTTTAACAAGA | Deoxy, MOE, and cEt | 9 | 10788 | 10803 | 4502 |
| 561589 | 1819 | 1834 | GTTTAGAGTTTTAACA | Deoxy, MOE, and cEt | 24 | 10791 | 10806 | 4503 |
| 561590 | 1822 | 1837 | CAAGTTTAGAGTTTTA | Deoxy, MOE, and cEt | 30 | 10794 | 10809 | 4504 |
| 561591 | 1824 | 1839 | GTCAAGTTTAGAGTTT | Deoxy, MOE, and cEt | 60 | 10796 | 10811 | 4505 |
| 561592 | 1826 | 1841 | TAGTCAAGTTTAGAGT | Deoxy, MOE, and cEt | 56 | 10798 | 10813 | 4506 |
| 561593 | 1828 | 1843 | TTTAGTCAAGTTTAGA | Deoxy, MOE, and cEt | 41 | 10800 | 10815 | 4507 |
| 561594 | 1830 | 1845 | TATTTAGTCAAGTTTA | Deoxy, MOE, and cEt | 14 | 10802 | 10817 | 4508 |
| 561595 | 1832 | 1847 | TGTATTTAGTCAAGTT | Deoxy, MOE, and cEt | 39 | 10804 | 10819 | 4509 |
| 561596 | 1834 | 1849 | TCTGTATTTAGTCAAG | Deoxy, MOE, and cEt | 51 | 10806 | 10821 | 4510 |
| 561597 | 1836 | 1851 | CCTCTGTATTTAGTCA | Deoxy, MOE, and cEt | 72 | 10808 | 10823 | 4511 |
| 561598 | 1838 | 1853 | GTCCTCTGTATTTAGT | Deoxy, MOE, and cEt | 55 | 10810 | 10825 | 4512 |
| 561599 | 1840 | 1855 | CAGTCCTCTGTATTTA | Deoxy, MOE, and cEt | 63 | 10812 | 10827 | 4513 |
| 561600 | 1842 | 1857 | ACCAGTCCTCTGTATT | Deoxy, MOE, and cEt | 66 | 10814 | 10829 | 4514 |
| 561601 | 1844 | 1859 | TTACCAGTCCTCTGTA | Deoxy, MOE, and cEt | 57 | 10816 | 10831 | 4515 |
| 561602 | 1846 | 1861 | AATTACCAGTCCTCTG | Deoxy, MOE, and cEt | 43 | 10818 | 10833 | 4516 |
| 561603 | 1848 | 1863 | ACAATTACCAGTCCTC | Deoxy, MOE, and cEt | 67 | 10820 | 10835 | 4517 |

TABLE 154

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561835 | N/A | N/A | GCAAATTTTCAGTGTT | Deoxy, MOE, and cEt | 49 | 3850 | 3865 | 4518 |
| 561836 | N/A | N/A | CGATTTGTAATTTTCA | Deoxy, MOE, and cEt | 20 | 3874 | 3889 | 4519 |
| 561837 | N/A | N/A | TTTAACCGATTTGTAA | Deoxy, MOE, and cEt | 42 | 3880 | 3895 | 4520 |
| 561838 | N/A | N/A | GTATAATTTAACCGAT | Deoxy, MOE, and cEt | 15 | 3886 | 3901 | 4521 |
| 561839 | N/A | N/A | CTAGATTGTATAATTT | Deoxy, MOE, and cEt | 15 | 3893 | 3908 | 4522 |
| 561840 | N/A | N/A | AGTGTTCTAGATTGTA | Deoxy, MOE, and cEt | 45 | 3899 | 3914 | 4523 |
| 561841 | N/A | N/A | TGACATAGTGTTCTAG | Deoxy, MOE, and cEt | 51 | 3905 | 3920 | 4524 |
| 561842 | N/A | N/A | GTGTAATGACATAGTG | Deoxy, MOE, and cEt | 58 | 3911 | 3926 | 4525 |
| 561843 | N/A | N/A | ACAATAGTGTAATGAC | Deoxy, MOE, and cEt | 12 | 3917 | 3932 | 4526 |
| 561844 | N/A | N/A | GTAATTTACAATAGTG | Deoxy, MOE, and cEt | 18 | 3924 | 3939 | 4527 |

TABLE 154-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561845 | N/A | N/A | CCTTCAGTAATTTACA | Deoxy, MOE, and cEt | 0 | 3930 | 3945 | 4528 |
| 561846 | N/A | N/A | TACTTACCTTCAGTAA | Deoxy, MOE, and cEt | 2 | 3936 | 3951 | 4529 |
| 561847 | N/A | N/A | CTGGAGAATAGTTTTA | Deoxy, MOE, and cEt | 19 | 3969 | 3984 | 4530 |
| 561848 | N/A | N/A | TTAAACACTGGAGAAT | Deoxy, MOE, and cEt | 14 | 3976 | 3991 | 4531 |
| 561849 | N/A | N/A | GCCCAGCATATTTTCA | Deoxy, MOE, and cEt | 22 | 4034 | 4049 | 4532 |
| 561850 | N/A | N/A | GAAAAAGCCCAGCATA | Deoxy, MOE, and cEt | 15 | 4040 | 4055 | 4533 |
| 561851 | N/A | N/A | GATTTTCTGAACTTCA | Deoxy, MOE, and cEt | 52 | 4063 | 4078 | 4534 |
| 561852 | N/A | N/A | GTACTATCTCTAAAAT | Deoxy, MOE, and cEt | 6 | 4081 | 4096 | 4535 |
| 561853 | N/A | N/A | TAAATTGTACTATCTC | Deoxy, MOE, and cEt | 13 | 4087 | 4102 | 4536 |
| 561854 | N/A | N/A | CACATATTTTTGTCCT | Deoxy, MOE, and cEt | 47 | 4115 | 4130 | 4537 |
| 561855 | N/A | N/A | CTTTCAAATAGCACAT | Deoxy, MOE, and cEt | 31 | 4126 | 4141 | 4538 |
| 561856 | N/A | N/A | GTATGCTTCTTTCAAA | Deoxy, MOE, and cEt | 22 | 4134 | 4149 | 4539 |
| 561857 | N/A | N/A | CCCCTTGTATGCTTCT | Deoxy, MOE, and cEt | 55 | 4140 | 4155 | 4540 |
| 561858 | N/A | N/A | TTCCTTCCCCTTGTAT | Deoxy, MOE, and cEt | 32 | 4146 | 4161 | 4541 |
| 561859 | N/A | N/A | TGGCAATTCCTTCCCC | Deoxy, MOE, and cEt | 43 | 4152 | 4167 | 4542 |
| 561860 | N/A | N/A | GAATATTGGCAATTCC | Deoxy, MOE, and cEt | 52 | 4158 | 4173 | 4543 |
| 561861 | N/A | N/A | CTAATAATGGATTTGA | Deoxy, MOE, and cEt | 0 | 4179 | 4194 | 4544 |
| 561862 | N/A | N/A | CTATCATAATCTAAAT | Deoxy, MOE, and cEt | 0 | 4202 | 4217 | 4545 |
| 561863 | N/A | N/A | GTAACACTATCATAAT | Deoxy, MOE, and cEt | 7 | 4208 | 4223 | 4546 |
| 561864 | N/A | N/A | AATTTCCTGTAACACT | Deoxy, MOE, and cEt | 17 | 4216 | 4231 | 4547 |
| 561865 | N/A | N/A | AAGTTGCTTTCCTCTT | Deoxy, MOE, and cEt | 12 | 4243 | 4258 | 4548 |
| 561866 | N/A | N/A | GGTTATAAGTTGCTTT | Deoxy, MOE, and cEt | 6 | 4249 | 4264 | 4549 |
| 561867 | N/A | N/A | TAGGTTGGTTATAAGT | Deoxy, MOE, and cEt | 10 | 4255 | 4270 | 4550 |
| 561868 | N/A | N/A | AGAGAGTAGGTTGGTT | Deoxy, MOE, and cEt | 10 | 4261 | 4276 | 4551 |
| 561869 | N/A | N/A | GGATATAGAGAGTAGG | Deoxy, MOE, and cEt | 23 | 4267 | 4282 | 4552 |
| 561870 | N/A | N/A | AAGTCTGGATATAGAG | Deoxy, MOE, and cEt | 13 | 4273 | 4288 | 4553 |
| 561871 | N/A | N/A | CTACAAAAGTCTGGAT | Deoxy, MOE, and cEt | 1 | 4279 | 4294 | 4554 |
| 561872 | N/A | N/A | CTTACCTGATTTTCTA | Deoxy, MOE, and cEt | 0 | 4385 | 4400 | 4555 |
| 561873 | N/A | N/A | TACTGACTTACCTGAT | Deoxy, MOE, and cEt | 2 | 4391 | 4406 | 4556 |
| 561874 | N/A | N/A | CCATTAAAATACTGAC | Deoxy, MOE, and cEt | 1 | 4400 | 4415 | 4557 |
| 561875 | N/A | N/A | GGACATACCATTAAAA | Deoxy, MOE, and cEt | 11 | 4407 | 4422 | 4558 |
| 561876 | N/A | N/A | AAGATGGGACATACCA | Deoxy, MOE, and cEt | 38 | 4413 | 4428 | 4559 |
| 561877 | N/A | N/A | GTGTGAAAGATGGGAC | Deoxy, MOE, and cEt | 25 | 4419 | 4434 | 4560 |
| 561878 | N/A | N/A | AGACCTGTGTGAAAGA | Deoxy, MOE, and cEt | 33 | 4425 | 4440 | 4561 |
| 561879 | N/A | N/A | TTTTACAGACCTGTGT | Deoxy, MOE, and cEt | 29 | 4431 | 4446 | 4562 |
| 561880 | N/A | N/A | CAGTGTTTTACAGAC | Deoxy, MOE, and cEt | 40 | 4437 | 4452 | 4563 |
| 561881 | N/A | N/A | TAGGATTCAGTGTTTT | Deoxy, MOE, and cEt | 62 | 4444 | 4459 | 4564 |
| 561882 | N/A | N/A | GTTAAAGCTTGTAAAT | Deoxy, MOE, and cEt | 16 | 4465 | 4480 | 4565 |
| 561883 | N/A | N/A | GATCCAGTTAAAGCTT | Deoxy, MOE, and cEt | 39 | 4471 | 4486 | 4566 |
| 561884 | N/A | N/A | ACTCATGATCCAGTTA | Deoxy, MOE, and cEt | 60 | 4477 | 4492 | 4567 |
| 561885 | N/A | N/A | AATTTTACTCATGATC | Deoxy, MOE, and cEt | 36 | 4483 | 4498 | 4568 |
| 561886 | N/A | N/A | TGTGATAATTTTACTC | Deoxy, MOE, and cEt | 30 | 4489 | 4504 | 4569 |
| 561887 | N/A | N/A | TGCTGATGTGATAATT | Deoxy, MOE, and cEt | 41 | 4495 | 4510 | 4570 |
| 561888 | N/A | N/A | CAGTTATGCTGATGTG | Deoxy, MOE, and cEt | 86 | 4501 | 4516 | 185 |
| 561889 | N/A | N/A | GCAATTTTAACAGTTA | Deoxy, MOE, and cEt | 13 | 4511 | 4526 | 4571 |
| 561890 | N/A | N/A | GAGCCTGCAATTTTAA | Deoxy, MOE, and cEt | 14 | 4517 | 4532 | 4572 |
| 561891 | N/A | N/A | TAGCTTCAGAGCCTGC | Deoxy, MOE, and cEt | 61 | 4525 | 4540 | 4573 |
| 561892 | N/A | N/A | GTTTATTAGCTTCAGA | Deoxy, MOE, and cEt | 45 | 4531 | 4546 | 4574 |
| 561893 | N/A | N/A | CAGGTAGTTTATTAGC | Deoxy, MOE, and cEt | 37 | 4537 | 4552 | 4575 |
| 561894 | N/A | N/A | TAAATGCAGGTAGTTT | Deoxy, MOE, and cEt | 11 | 4543 | 4558 | 4576 |
| 561895 | N/A | N/A | ATGGTTTAAATGCAGG | Deoxy, MOE, and cEt | 53 | 4549 | 4564 | 4577 |
| 561896 | N/A | N/A | TAGAGCCATGGTTTAA | Deoxy, MOE, and cEt | 58 | 4556 | 4571 | 4578 |
| 561897 | N/A | N/A | AAGTTTTAGAGCCATG | Deoxy, MOE, and cEt | 81 | 4562 | 4577 | 186 |
| 561898 | N/A | N/A | TCACACAAAGTTTTAG | Deoxy, MOE, and cEt | 17 | 4569 | 4584 | 4579 |
| 561899 | N/A | N/A | GTGAAGTAATTTATTC | Deoxy, MOE, and cEt | 8 | 4589 | 4604 | 4580 |
| 561900 | N/A | N/A | ACTGAGAGATAAAGGG | Deoxy, MOE, and cEt | 34 | 4605 | 4620 | 4581 |
| 561901 | N/A | N/A | GTATATGTGAGGAAAC | Deoxy, MOE, and cEt | 18 | 4619 | 4634 | 4582 |
| 561902 | N/A | N/A | TTTGTAGTATATGTGA | Deoxy, MOE, and cEt | 3 | 4625 | 4640 | 4583 |
| 561903 | N/A | N/A | ATTATCTTTGTAGTAT | Deoxy, MOE, and cEt | 8 | 4631 | 4646 | 4584 |
| 561904 | N/A | N/A | ATAAGTTCTGTTATTA | Deoxy, MOE, and cEt | 18 | 4643 | 4658 | 4585 |
| 561905 | N/A | N/A | AATCCTATAAGTTCTG | Deoxy, MOE, and cEt | 55 | 4649 | 4664 | 4586 |
| 561906 | N/A | N/A | CTGCTATGAATTAATT | Deoxy, MOE, and cEt | 16 | 4679 | 4694 | 4587 |
| 561907 | N/A | N/A | CATTGGCTGCTATGAA | Deoxy, MOE, and cEt | 48 | 4685 | 4700 | 4588 |
| 561908 | N/A | N/A | AGATGACATTGGCTGC | Deoxy, MOE, and cEt | 71 | 4691 | 4706 | 4589 |
| 561909 | N/A | N/A | TTAGTAAGATGACATT | Deoxy, MOE, and cEt | 0 | 4697 | 4712 | 4590 |
| 561910 | N/A | N/A | GATCTAATTTGAATTT | Deoxy, MOE, and cEt | 7 | 4712 | 4727 | 4591 |
| 561911 | N/A | N/A | TTGAGCAAAGAGAAAC | Deoxy, MOE, and cEt | 6 | 4730 | 4745 | 4592 |
| 561989 | N/A | N/A | GAATGTTGACCTTTAA | Deoxy, MOE, and cEt | 49 | 5356 | 5371 | 4593 |
| 561990 | N/A | N/A | ATTGTTGAATGTTGAC | Deoxy, MOE, and cEt | 57 | 5362 | 5377 | 4594 |
| 561991 | N/A | N/A | TTAATTACATTGTTGA | Deoxy, MOE, and cEt | 0 | 5370 | 5385 | 4595 |
| 561992 | N/A | N/A | TTGTAGATTAATTACA | Deoxy, MOE, and cEt | 18 | 5377 | 5392 | 4596 |
| 561993 | N/A | N/A | TTTACATTGTAGATTA | Deoxy, MOE, and cEt | 3 | 5383 | 5398 | 4597 |

TABLE 154-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 561994 | N/A | N/A | CAGATGTTTACATTGT | Deoxy, MOE, and cEt | 71 | 5389 | 5404 | 4598 |
| 561995 | N/A | N/A | CTTCACCAGATGTTTA | Deoxy, MOE, and cEt | 19 | 5395 | 5410 | 4599 |
| 561996 | N/A | N/A | CTGTCACTTCACCAGA | Deoxy, MOE, and cEt | 77 | 5401 | 5416 | 187 |
| 561997 | N/A | N/A | AGTGCTTCCCTCTGTC | Deoxy, MOE, and cEt | 66 | 5412 | 5427 | 4600 |
| 561998 | N/A | N/A | TAAACAAGTGCTTCCC | Deoxy, MOE, and cEt | 62 | 5418 | 5433 | 4601 |
| 561999 | N/A | N/A | TAGCTTTTTTCTAAAC | Deoxy, MOE, and cEt | 0 | 5429 | 5444 | 4602 |
| 562000 | N/A | N/A | CTGACATAGCTTTTT | Deoxy, MOE, and cEt | 66 | 5435 | 5450 | 4603 |
| 562001 | N/A | N/A | TGGATTCTGACATAGC | Deoxy, MOE, and cEt | 85 | 5441 | 5456 | 188 |
| 562002 | N/A | N/A | AATACATGGATTCTGA | Deoxy, MOE, and cEt | 35 | 5447 | 5462 | 4604 |
| 562003 | N/A | N/A | TATTAGAATACATGGA | Deoxy, MOE, and cEt | 7 | 5453 | 5468 | 4605 |
| 562004 | N/A | N/A | GTACTGCATATTAGAA | Deoxy, MOE, and cEt | 48 | 5461 | 5476 | 4606 |
| 562005 | N/A | N/A | ACTATTGTACTGCATA | Deoxy, MOE, and cEt | 53 | 5467 | 5482 | 4607 |
| 562006 | N/A | N/A | TTTTAAACTATTGTAC | Deoxy, MOE, and cEt | 0 | 5473 | 5488 | 4608 |
| 562007 | N/A | N/A | GAGAGTATTATTAATA | Deoxy, MOE, and cEt | 8 | 5490 | 5505 | 4609 |
| 562008 | N/A | N/A | CTGTTTGAGAGTATTA | Deoxy, MOE, and cEt | 0 | 5496 | 5511 | 4610 |
| 562009 | N/A | N/A | GAATAGCTGTTTGAGA | Deoxy, MOE, and cEt | 34 | 5502 | 5517 | 4611 |
| 562010 | N/A | N/A | AATCCTCTTGAATAGC | Deoxy, MOE, and cEt | 62 | 5511 | 5526 | 4612 |
| 562011 | N/A | N/A | TTTTTGAATCCTCTTG | Deoxy, MOE, and cEt | 50 | 5517 | 5532 | 4613 |
| 562012 | N/A | N/A | GAGTTTATATTATGTT | Deoxy, MOE, and cEt | 5 | 5532 | 5547 | 4614 |
| 562013 | N/A | N/A | GTTTCTCTGAGTTTAT | Deoxy, MOE, and cEt | 58 | 5540 | 5555 | 4615 |
| 562014 | N/A | N/A | TTACCAGTTTCTCTGA | Deoxy, MOE, and cEt | 64 | 5546 | 5561 | 4616 |
| 562015 | N/A | N/A | GATTTTGTTTACCAGT | Deoxy, MOE, and cEt | 68 | 5554 | 5569 | 4617 |
| 562016 | N/A | N/A | GTTTTATATCTCTTGA | Deoxy, MOE, and cEt | 33 | 5574 | 5589 | 4618 |
| 562017 | N/A | N/A | TTGGTAATAATATTTG | Deoxy, MOE, and cEt | 13 | 5589 | 5604 | 4619 |
| 562018 | N/A | N/A | TGGAAATTGGTAATAA | Deoxy, MOE, and cEt | 1 | 5595 | 5610 | 4620 |
| 562019 | N/A | N/A | GTTTAGTGGAAATTGG | Deoxy, MOE, and cEt | 44 | 5601 | 5616 | 4621 |
| 562020 | N/A | N/A | ATGTTTGTTTAGTGGA | Deoxy, MOE, and cEt | 47 | 5607 | 5622 | 4622 |
| 562021 | N/A | N/A | CTAACATTATGTTTGT | Deoxy, MOE, and cEt | 0 | 5615 | 5630 | 4623 |
| 562022 | N/A | N/A | GCACTACTAACATTAT | Deoxy, MOE, and cEt | 42 | 5621 | 5636 | 4624 |
| 562023 | N/A | N/A | TTAGCAGCACTACTAA | Deoxy, MOE, and cEt | 35 | 5627 | 5642 | 4625 |
| 562024 | N/A | N/A | AACCTTTTAGCAGCAC | Deoxy, MOE, and cEt | 76 | 5633 | 5648 | 189 |
| 562025 | N/A | N/A | TTGATAAAAAACCTTT | Deoxy, MOE, and cEt | 0 | 5642 | 5657 | 4626 |
| 562026 | N/A | N/A | CAAAAGTAGTTGATAA | Deoxy, MOE, and cEt | 0 | 5651 | 5666 | 4627 |
| 562027 | N/A | N/A | GGAAACCAAAAGTAGT | Deoxy, MOE, and cEt | 28 | 5657 | 5672 | 4628 |
| 562028 | N/A | N/A | GAAAGTATGGAAACCA | Deoxy, MOE, and cEt | 52 | 5665 | 5680 | 4629 |
| 562029 | N/A | N/A | ACATCATAAGAAGGAA | Deoxy, MOE, and cEt | 8 | 5678 | 5693 | 4630 |
| 562030 | N/A | N/A | TCATAGTAAAAGATAT | Deoxy, MOE, and cEt | 0 | 5718 | 5733 | 4631 |
| 562031 | N/A | N/A | TCATTTAATCATAGTA | Deoxy, MOE, and cEt | 7 | 5726 | 5741 | 4632 |
| 562032 | N/A | N/A | GCAGGTTCATTTAATC | Deoxy, MOE, and cEt | 56 | 5732 | 5747 | 4633 |
| 562033 | N/A | N/A | GTAACATTTTGCTTTG | Deoxy, MOE, and cEt | 44 | 5752 | 5767 | 4634 |
| 562034 | N/A | N/A | ATATTACTATAGTAAC | Deoxy, MOE, and cEt | 4 | 5763 | 5778 | 4635 |
| 562035 | N/A | N/A | CAATGTATATTACTAT | Deoxy, MOE, and cEt | 19 | 5769 | 5784 | 4636 |
| 562036 | N/A | N/A | TAGACACAATGTATAT | Deoxy, MOE, and cEt | 17 | 5775 | 5790 | 4637 |
| 562037 | N/A | N/A | GGTTTCTTCACACATT | Deoxy, MOE, and cEt | 63 | 5799 | 5814 | 4638 |
| 562038 | N/A | N/A | CTCAGAAATTCATTGT | Deoxy, MOE, and cEt | 36 | 5818 | 5833 | 4639 |
| 562039 | N/A | N/A | CTTCTTCCAACTCAGA | Deoxy, MOE, and cEt | 56 | 5828 | 5843 | 4640 |
| 562040 | N/A | N/A | CTAACTCTTCTTCCAA | Deoxy, MOE, and cEt | 39 | 5834 | 5849 | 4641 |
| 562041 | N/A | N/A | AATGATCTAACTCTTC | Deoxy, MOE, and cEt | 33 | 5840 | 5855 | 4642 |
| 562042 | N/A | N/A | GAAAGTTAAATGATCT | Deoxy, MOE, and cEt | 3 | 5848 | 5863 | 4643 |
| 562043 | N/A | N/A | ATCTTAAAGTTACTTA | Deoxy, MOE, and cEt | 56 | 5900 | 5915 | 4644 |
| 562044 | N/A | N/A | TATGTGATCTTAAAGT | Deoxy, MOE, and cEt | 5 | 5906 | 5921 | 4645 |
| 562045 | N/A | N/A | AGTAACTATGTGATCT | Deoxy, MOE, and cEt | 60 | 5912 | 5927 | 4646 |
| 562046 | N/A | N/A | CTACTAAGTAACTATG | Deoxy, MOE, and cEt | 0 | 5918 | 5933 | 4647 |
| 562047 | N/A | N/A | TCTTTTCTACTAAGTA | Deoxy, MOE, and cEt | 18 | 5924 | 5939 | 4648 |
| 562048 | N/A | N/A | TATTACTCTTTTCTAC | Deoxy, MOE, and cEt | 3 | 5930 | 5945 | 4649 |
| 562049 | N/A | N/A | GCTGGGTATTACTCTT | Deoxy, MOE, and cEt | 76 | 5936 | 5951 | 4650 |
| 562050 | N/A | N/A | TTGCTTGCTGGGTATT | Deoxy, MOE, and cEt | 77 | 5942 | 5957 | 190 |
| 562051 | N/A | N/A | TAAAGTTTGCTTGCTG | Deoxy, MOE, and cEt | 58 | 5948 | 5963 | 4651 |
| 562052 | N/A | N/A | CTATTGTAAAGTTTGC | Deoxy, MOE, and cEt | 16 | 5954 | 5969 | 4652 |
| 562053 | N/A | N/A | AAGGATCTATTGTAAA | Deoxy, MOE, and cEt | 5 | 5960 | 5975 | 4653 |
| 562054 | N/A | N/A | CTTATTTAAAAGGATC | Deoxy, MOE, and cEt | 0 | 5969 | 5984 | 4654 |
| 562055 | N/A | N/A | TAGGACCTTATTTAAA | Deoxy, MOE, and cEt | 0 | 5975 | 5990 | 4655 |
| 562056 | N/A | N/A | ATTTCCTAGGACCTTA | Deoxy, MOE, and cEt | 10 | 5981 | 5996 | 4656 |
| 562057 | N/A | N/A | CATGAATGATATTTCC | Deoxy, MOE, and cEt | 39 | 5991 | 6006 | 4657 |
| 562058 | N/A | N/A | TGCTGGCATGAATGAT | Deoxy, MOE, and cEt | 62 | 5997 | 6012 | 4658 |
| 562059 | N/A | N/A | TTTTGATGCTGGCATG | Deoxy, MOE, and cEt | 74 | 6003 | 6018 | 4659 |
| 562060 | N/A | N/A | TTAGTTTTTTGATGCT | Deoxy, MOE, and cEt | 25 | 6009 | 6024 | 4660 |
| 562061 | N/A | N/A | GCATTATTAGTGTTAG | Deoxy, MOE, and cEt | 44 | 6021 | 6036 | 4661 |
| 562062 | N/A | N/A | TATCTTGCATTATTAG | Deoxy, MOE, and cEt | 35 | 6027 | 6042 | 4662 |
| 562063 | N/A | N/A | ATATAATATCTTGCAT | Deoxy, MOE, and cEt | 0 | 6033 | 6048 | 4663 |
| 562064 | N/A | N/A | CATTGACAGTAAGAAA | Deoxy, MOE, and cEt | 0 | 6057 | 6072 | 4664 |
| 562065 | N/A | N/A | AGTTTTTCTCATTGAC | Deoxy, MOE, and cEt | 62 | 6066 | 6081 | 4665 |

TABLE 154-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562143 | N/A | N/A | ATGGATATCTCTTAAC | Deoxy, MOE, and cEt | 18 | 6869 | 6884 | 4666 |
| 562144 | N/A | N/A | TATTTGATGGATATCT | Deoxy, MOE, and cEt | 35 | 6875 | 6890 | 4667 |
| 562145 | N/A | N/A | ACATTGTATTTGATGG | Deoxy, MOE, and cEt | 41 | 6881 | 6896 | 4668 |
| 562146 | N/A | N/A | GTTGATACATTGTATT | Deoxy, MOE, and cEt | 8 | 6887 | 6902 | 4669 |
| 562147 | N/A | N/A | GTTTAGGTTGATACAT | Deoxy, MOE, and cEt | 35 | 6893 | 6908 | 4670 |
| 562148 | N/A | N/A | CATCCAGTTTAGGTTG | Deoxy, MOE, and cEt | 59 | 6899 | 6914 | 4671 |
| 562149 | N/A | N/A | CCCCAGCATCCAGTTT | Deoxy, MOE, and cEt | 37 | 6905 | 6920 | 4672 |
| 562150 | N/A | N/A | AAAGAACCCCAGCATC | Deoxy, MOE, and cEt | 35 | 6911 | 6926 | 4673 |
| 562151 | N/A | N/A | GTGTAAAAAGAACCCC | Deoxy, MOE, and cEt | 33 | 6917 | 6932 | 4674 |
| 562152 | N/A | N/A | TATAGGGTGTAAAAAG | Deoxy, MOE, and cEt | 0 | 6923 | 6938 | 4675 |
| 562153 | N/A | N/A | GTCTTTTATAGGGTGT | Deoxy, MOE, and cEt | 75 | 6929 | 6944 | 191 |
| 562154 | N/A | N/A | AGGTATGTCTTTTATA | Deoxy, MOE, and cEt | 21 | 6935 | 6950 | 4676 |
| 562155 | N/A | N/A | TTGTCTTAGGTATGTC | Deoxy, MOE, and cEt | 84 | 6942 | 6957 | 192 |
| 562156 | N/A | N/A | CTCTGATTGTCTTAGG | Deoxy, MOE, and cEt | 77 | 6948 | 6963 | 193 |
| 562157 | N/A | N/A | GTATTTCTCTGATTGT | Deoxy, MOE, and cEt | 77 | 6954 | 6969 | 194 |
| 562158 | N/A | N/A | AGTCCATATTTGTATT | Deoxy, MOE, and cEt | 49 | 6965 | 6980 | 4677 |
| 562159 | N/A | N/A | TAATCAAGTCCATATT | Deoxy, MOE, and cEt | 19 | 6971 | 6986 | 4678 |
| 562160 | N/A | N/A | ATCTAATAATCAAGTC | Deoxy, MOE, and cEt | 5 | 6977 | 6992 | 4679 |
| 562161 | N/A | N/A | CCTTCTATATTATCTA | Deoxy, MOE, and cEt | 38 | 6988 | 7003 | 4680 |
| 562162 | N/A | N/A | TAATAAACCTTCTATA | Deoxy, MOE, and cEt | 8 | 6995 | 7010 | 4681 |
| 562163 | N/A | N/A | GATCACATCTAAGAAA | Deoxy, MOE, and cEt | 25 | 7013 | 7028 | 4682 |
| 562164 | N/A | N/A | TACCATGATCACATCT | Deoxy, MOE, and cEt | 66 | 7019 | 7034 | 4683 |
| 562165 | N/A | N/A | CTGCAATACCATGATC | Deoxy, MOE, and cEt | 54 | 7025 | 7040 | 4684 |
| 562166 | N/A | N/A | GTTCTCCTTTAAAACT | Deoxy, MOE, and cEt | 0 | 7039 | 7054 | 4685 |
| 562167 | N/A | N/A | GAGATTGTTCTCCTTT | Deoxy, MOE, and cEt | 7 | 7045 | 7060 | 4686 |
| 562168 | N/A | N/A | AAACAGGAGATTGTTC | Deoxy, MOE, and cEt | 6 | 7051 | 7066 | 4687 |
| 562169 | N/A | N/A | TCTCTTAAACAGGAGA | Deoxy, MOE, and cEt | 1 | 7057 | 7072 | 4688 |
| 562170 | N/A | N/A | CATGTATCTCTTAAAC | Deoxy, MOE, and cEt | 40 | 7063 | 7078 | 4689 |
| 562171 | N/A | N/A | CGTAAATATTTCAGCA | Deoxy, MOE, and cEt | 30 | 7077 | 7092 | 4690 |
| 562172 | N/A | N/A | TAACTCCGTAAATATT | Deoxy, MOE, and cEt | 0 | 7083 | 7098 | 4691 |
| 562173 | N/A | N/A | GACCTTTAACTCCGTA | Deoxy, MOE, and cEt | 68 | 7089 | 7104 | 4692 |
| 562174 | N/A | N/A | TCCAGTGACCTTTAAC | Deoxy, MOE, and cEt | 6 | 7095 | 7110 | 4693 |
| 562175 | N/A | N/A | CACCAGTCTGGAGTCC | Deoxy, MOE, and cEt | 52 | 7108 | 7123 | 4694 |
| 562176 | N/A | N/A | TTCTATCACCAGTCTG | Deoxy, MOE, and cEt | 67 | 7114 | 7129 | 4695 |
| 562177 | N/A | N/A | ATCTTACCAAACTATT | Deoxy, MOE, and cEt | 23 | 7171 | 7186 | 4696 |
| 562178 | N/A | N/A | AGAATCATCTTACCAA | Deoxy, MOE, and cEt | 55 | 7177 | 7192 | 4697 |
| 562179 | N/A | N/A | GAATGTAAGAATCATC | Deoxy, MOE, and cEt | 0 | 7184 | 7199 | 4698 |
| 562180 | N/A | N/A | GTGTTATTTAAGAATG | Deoxy, MOE, and cEt | 0 | 7195 | 7210 | 4699 |
| 562181 | N/A | N/A | TTTTTCTTAGATGGCG | Deoxy, MOE, and cEt | 82 | 7210 | 7225 | 195 |
| 562182 | N/A | N/A | GTTTATGTTAAAGCAT | Deoxy, MOE, and cEt | 8 | 7225 | 7240 | 4700 |
| 562183 | N/A | N/A | AGTAATGTTTATGTTA | Deoxy, MOE, and cEt | 4 | 7231 | 7246 | 4701 |
| 562184 | N/A | N/A | GTAGCATTTTTTCAGT | Deoxy, MOE, and cEt | 58 | 7244 | 7259 | 4702 |
| 562185 | N/A | N/A | GCAAATGTAGCATTTT | Deoxy, MOE, and cEt | 61 | 7250 | 7265 | 4703 |
| 562186 | N/A | N/A | GTTGTGGCAAATGTAG | Deoxy, MOE, and cEt | 32 | 7256 | 7271 | 4704 |
| 562187 | N/A | N/A | TATGAAGTTGTGGCAA | Deoxy, MOE, and cEt | 54 | 7262 | 7277 | 4705 |
| 562188 | N/A | N/A | GATTTCACTTGACATT | Deoxy, MOE, and cEt | 19 | 7279 | 7294 | 4706 |
| 562189 | N/A | N/A | GCTTGAGATTTCACTT | Deoxy, MOE, and cEt | 42 | 7285 | 7300 | 4707 |
| 562190 | N/A | N/A | TTTGGAGCTTGAGATT | Deoxy, MOE, and cEt | 22 | 7291 | 7306 | 4708 |
| 562191 | N/A | N/A | AATATCTTTGGAGCTT | Deoxy, MOE, and cEt | 36 | 7297 | 7312 | 4709 |
| 562192 | N/A | N/A | AGGAATAATATCTTTG | Deoxy, MOE, and cEt | 5 | 7303 | 7318 | 4710 |
| 562193 | N/A | N/A | ATTTAGTAATAGGAAT | Deoxy, MOE, and cEt | 5 | 7313 | 7328 | 4711 |
| 562194 | N/A | N/A | CATCAGATTTAGTAAT | Deoxy, MOE, and cEt | 0 | 7319 | 7334 | 4712 |
| 562195 | N/A | N/A | GTTATTACATCAGATT | Deoxy, MOE, and cEt | 23 | 7326 | 7341 | 4713 |
| 562196 | N/A | N/A | GCCTAGAATCAATAAA | Deoxy, MOE, and cEt | 8 | 7344 | 7359 | 4714 |
| 562197 | N/A | N/A | AGGAATGCCTAGAATC | Deoxy, MOE, and cEt | 2 | 7350 | 7365 | 4715 |
| 562198 | N/A | N/A | TTCAGCAGGAATGCCT | Deoxy, MOE, and cEt | 46 | 7356 | 7371 | 4716 |
| 562199 | N/A | N/A | TTACCTGATATAACAT | Deoxy, MOE, and cEt | 41 | 7460 | 7475 | 4717 |
| 562200 | N/A | N/A | CAGGTTTTACCTGATA | Deoxy, MOE, and cEt | 31 | 7466 | 7481 | 4718 |
| 562201 | N/A | N/A | CTTAGACAGGTTTTAC | Deoxy, MOE, and cEt | 41 | 7472 | 7487 | 4719 |
| 562202 | N/A | N/A | ATTCTCCTTAGACAGG | Deoxy, MOE, and cEt | 37 | 7478 | 7493 | 4720 |
| 562203 | N/A | N/A | CTGTCTATTCTCCTTA | Deoxy, MOE, and cEt | 53 | 7484 | 7499 | 4721 |
| 562204 | N/A | N/A | TAACTACTGTCTATTC | Deoxy, MOE, and cEt | 5 | 7490 | 7505 | 4722 |
| 562205 | N/A | N/A | TTGAACTAACTACTGT | Deoxy, MOE, and cEt | 3 | 7496 | 7511 | 4723 |
| 562206 | N/A | N/A | AGTAAGTTGAACTAAC | Deoxy, MOE, and cEt | 11 | 7502 | 7517 | 4724 |
| 562207 | N/A | N/A | GTAATGAGTAAGTTGA | Deoxy, MOE, and cEt | 37 | 7508 | 7523 | 4725 |
| 562208 | N/A | N/A | TAATCTTCCTAATACG | Deoxy, MOE, and cEt | 5 | 7523 | 7538 | 4726 |
| 562209 | N/A | N/A | ACCAGGTTAATCTTCC | Deoxy, MOE, and cEt | 71 | 7530 | 7545 | 4727 |
| 562210 | N/A | N/A | ATGATAACCAGGTTAA | Deoxy, MOE, and cEt | 42 | 7536 | 7551 | 4728 |
| 562211 | N/A | N/A | CGAATACTCATATATA | Deoxy, MOE, and cEt | 20 | 7576 | 7591 | 4729 |
| 562212 | N/A | N/A | TTTATACGAATACTCA | Deoxy, MOE, and cEt | 17 | 7582 | 7597 | 4730 |
| 562213 | N/A | N/A | ATTATATTTATACGAA | Deoxy, MOE, and cEt | 0 | 7588 | 7603 | 4731 |
| 562214 | N/A | N/A | GGTAAAAGTATTATAT | Deoxy, MOE, and cEt | 0 | 7597 | 7612 | 4732 |

TABLE 154-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562215 | N/A | N/A | GAGAATATTGAGTAAA | Deoxy, MOE, and cEt | 9 | 7624 | 7639 | 4733 |
| 562216 | N/A | N/A | CAGATTATTTTAGAGG | Deoxy, MOE, and cEt | 16 | 7645 | 7660 | 4734 |
| 562217 | N/A | N/A | TCACTTCAGATTATTT | Deoxy, MOE, and cEt | 34 | 7651 | 7666 | 4735 |
| 562218 | N/A | N/A | TAATAGTCACTTCAGA | Deoxy, MOE, and cEt | 33 | 7657 | 7672 | 4736 |
| 562219 | N/A | N/A | TATTGATAATAGTCAC | Deoxy, MOE, and cEt | 1 | 7663 | 7678 | 4737 |
| 562297 | N/A | N/A | TACTATTTGTAATCAA | Deoxy, MOE, and cEt | 0 | 8493 | 8508 | 4738 |
| 562298 | N/A | N/A | CTTGCTTATTTTACTA | Deoxy, MOE, and cEt | 24 | 8504 | 8519 | 4739 |
| 562299 | N/A | N/A | CATCTGTTATTTTATC | Deoxy, MOE, and cEt | 0 | 8519 | 8534 | 4740 |
| 562300 | N/A | N/A | ATGTGCTTTTTGGATT | Deoxy, MOE, and cEt | 20 | 8540 | 8555 | 4741 |
| 562301 | N/A | N/A | GGATTTTTGTATGTGC | Deoxy, MOE, and cEt | 64 | 8550 | 8565 | 4742 |
| 562302 | N/A | N/A | CATCATTCATGGATTT | Deoxy, MOE, and cEt | 55 | 8560 | 8575 | 4743 |
| 562303 | N/A | N/A | CTTAGACATCATTCAT | Deoxy, MOE, and cEt | 32 | 8566 | 8581 | 4744 |
| 562304 | N/A | N/A | TGAGTACTTAGACATC | Deoxy, MOE, and cEt | 58 | 8572 | 8587 | 4745 |
| 562305 | N/A | N/A | TATAAGTGAGTACTTA | Deoxy, MOE, and cEt | 3 | 8578 | 8593 | 4746 |
| 562306 | N/A | N/A | CTACTTTATAAGTGAG | Deoxy, MOE, and cEt | 0 | 8584 | 8599 | 4747 |
| 562307 | N/A | N/A | TGAATGTCTTCTACTT | Deoxy, MOE, and cEt | 42 | 8594 | 8609 | 4748 |
| 562308 | N/A | N/A | TATAATAATGAATGTC | Deoxy, MOE, and cEt | 2 | 8602 | 8617 | 4749 |
| 562309 | N/A | N/A | GTACTGAGCATTTAAA | Deoxy, MOE, and cEt | 24 | 8625 | 8640 | 4750 |
| 562310 | N/A | N/A | CAAATAGTACTGAGCA | Deoxy, MOE, and cEt | 48 | 8631 | 8646 | 4751 |
| 562311 | N/A | N/A | AATGGTCAAATAGTAC | Deoxy, MOE, and cEt | 0 | 8637 | 8652 | 4752 |
| 562312 | N/A | N/A | GTAGTTTGAATACAAA | Deoxy, MOE, and cEt | 9 | 8660 | 8675 | 4753 |
| 562313 | N/A | N/A | TCACTGGTAGTTTGAA | Deoxy, MOE, and cEt | 56 | 8666 | 8681 | 4754 |
| 562314 | N/A | N/A | GGGCTTTCACTGGTAG | Deoxy, MOE, and cEt | 70 | 8672 | 8687 | 196 |
| 562315 | N/A | N/A | TAGGTAGGGCTTTCAC | Deoxy, MOE, and cEt | 50 | 8678 | 8693 | 4755 |
| 562316 | N/A | N/A | ACCTTCTAGGTAGGGC | Deoxy, MOE, and cEt | 47 | 8684 | 8699 | 4756 |
| 562317 | N/A | N/A | GAGTATACCTTCTAGG | Deoxy, MOE, and cEt | 38 | 8690 | 8705 | 4757 |
| 562318 | N/A | N/A | ATCACTGAGTATACCT | Deoxy, MOE, and cEt | 61 | 8696 | 8711 | 4758 |
| 562319 | N/A | N/A | AAACTTATCACTGAGT | Deoxy, MOE, and cEt | 0 | 8702 | 8717 | 4759 |
| 562320 | N/A | N/A | GCTACAAAACTTATCA | Deoxy, MOE, and cEt | 8 | 8708 | 8723 | 4760 |
| 562321 | N/A | N/A | TTTGGAGCTACAAAAC | Deoxy, MOE, and cEt | 0 | 8714 | 8729 | 4761 |
| 562322 | N/A | N/A | AGAAGATTTGGAGCTA | Deoxy, MOE, and cEt | 24 | 8720 | 8735 | 4762 |
| 562323 | N/A | N/A | ACTATTAGAAGATTTG | Deoxy, MOE, and cEt | 0 | 8726 | 8741 | 4763 |
| 562324 | N/A | N/A | ACACTCACTATTAGAA | Deoxy, MOE, and cEt | 0 | 8732 | 8747 | 4764 |
| 562325 | N/A | N/A | AGCCTTTTATTTTGGG | Deoxy, MOE, and cEt | 37 | 8751 | 8766 | 4765 |
| 562326 | N/A | N/A | CCTGTCAGCCTTTTAT | Deoxy, MOE, and cEt | 0 | 8757 | 8772 | 4766 |
| 562327 | N/A | N/A | GACTTACCTGTCAGCC | Deoxy, MOE, and cEt | 47 | 8763 | 8778 | 4767 |
| 562328 | N/A | N/A | ATTCTCGACTTACCTG | Deoxy, MOE, and cEt | 12 | 8769 | 8784 | 4768 |
| 562329 | N/A | N/A | GTGAGTATTCTCGACT | Deoxy, MOE, and cEt | 25 | 8775 | 8790 | 4769 |
| 562330 | N/A | N/A | AATTAAGTGAGTATTC | Deoxy, MOE, and cEt | 0 | 8781 | 8796 | 4770 |
| 562331 | N/A | N/A | TACCAGAATTAAGTGA | Deoxy, MOE, and cEt | 0 | 8787 | 8802 | 4771 |
| 562332 | N/A | N/A | GCTTTCTTACCAGAAT | Deoxy, MOE, and cEt | 23 | 8794 | 8809 | 4772 |
| 562333 | N/A | N/A | TGGGTTGCTTTCTTAC | Deoxy, MOE, and cEt | 0 | 8800 | 8815 | 4773 |
| 562334 | N/A | N/A | TACAAGTACAAATGGG | Deoxy, MOE, and cEt | 36 | 8812 | 8827 | 4774 |
| 562335 | N/A | N/A | GGTAAATACAAGTACA | Deoxy, MOE, and cEt | 19 | 8818 | 8833 | 4775 |
| 562336 | N/A | N/A | ATTGCTGGTAAATACA | Deoxy, MOE, and cEt | 13 | 8824 | 8839 | 4776 |
| 562337 | N/A | N/A | TTAAGGATTGCTGGTA | Deoxy, MOE, and cEt | 43 | 8830 | 8845 | 4777 |
| 562338 | N/A | N/A | GCTTCATTTTAAGGAT | Deoxy, MOE, and cEt | 12 | 8838 | 8853 | 4778 |
| 562339 | N/A | N/A | GTAGGAAGCTTCATTT | Deoxy, MOE, and cEt | 23 | 8845 | 8860 | 4779 |
| 562340 | N/A | N/A | GAGTTAGTAGGAAGCT | Deoxy, MOE, and cEt | 58 | 8851 | 8866 | 4780 |
| 562341 | N/A | N/A | GCTATTGAGTTAGTAG | Deoxy, MOE, and cEt | 21 | 8857 | 8872 | 4781 |
| 562342 | N/A | N/A | CTTATTGCTATTGAGT | Deoxy, MOE, and cEt | 34 | 8863 | 8878 | 4782 |
| 562343 | N/A | N/A | TATTGTCTTATTGCTA | Deoxy, MOE, and cEt | 17 | 8869 | 8884 | 4783 |
| 562344 | N/A | N/A | ATTCACTATTGTCTTA | Deoxy, MOE, and cEt | 22 | 8875 | 8890 | 4784 |
| 562345 | N/A | N/A | ATCACAATCCTTTTA | Deoxy, MOE, and cEt | 18 | 8925 | 8940 | 4785 |
| 562346 | N/A | N/A | TTCTTCATCACAATCC | Deoxy, MOE, and cEt | 43 | 8931 | 8946 | 4786 |
| 562347 | N/A | N/A | AGATTGTTCTTCATCA | Deoxy, MOE, and cEt | 35 | 8937 | 8952 | 4787 |
| 562348 | N/A | N/A | TATAAATAGATTGTTC | Deoxy, MOE, and cEt | 10 | 8944 | 8959 | 4788 |
| 562349 | N/A | N/A | GGTTCTTAATAACTTT | Deoxy, MOE, and cEt | 31 | 9011 | 9026 | 4789 |
| 562350 | N/A | N/A | AAGCATGGTTCTTAAT | Deoxy, MOE, and cEt | 12 | 9017 | 9032 | 4790 |
| 562351 | N/A | N/A | CTTTGTAGAAAAAGAC | Deoxy, MOE, and cEt | 0 | 9066 | 9081 | 4791 |
| 562352 | N/A | N/A | TATGCTTTCTTTGTAG | Deoxy, MOE, and cEt | 26 | 9074 | 9089 | 4792 |
| 562353 | N/A | N/A | CTTAATGTATGCTTTC | Deoxy, MOE, and cEt | 55 | 9081 | 9096 | 4793 |
| 562354 | N/A | N/A | GTATTTGCTTAATGTA | Deoxy, MOE, and cEt | 0 | 9088 | 9103 | 4794 |
| 562355 | N/A | N/A | CCTTTGGTATTTGCTT | Deoxy, MOE, and cEt | 54 | 9094 | 9109 | 4795 |
| 562356 | N/A | N/A | ACCTGGCCTTTGGTAT | Deoxy, MOE, and cEt | 0 | 9100 | 9115 | 4796 |
| 562357 | N/A | N/A | ATGTAAACCTGGCCTT | Deoxy, MOE, and cEt | 1 | 9106 | 9121 | 4797 |
| 562358 | N/A | N/A | CTTCAAATGTAAACCT | Deoxy, MOE, and cEt | 0 | 9112 | 9127 | 4798 |
| 562359 | N/A | N/A | GTAATAATAATGTCAC | Deoxy, MOE, and cEt | 0 | 9131 | 9146 | 4799 |
| 562360 | N/A | N/A | AGACTTGAGTAATAAT | Deoxy, MOE, and cEt | 0 | 9139 | 9154 | 4800 |
| 562361 | N/A | N/A | TCCTAGAGACTTGAGT | Deoxy, MOE, and cEt | 25 | 9145 | 9160 | 4801 |
| 562362 | N/A | N/A | AAGTATTCCTAGAGAC | Deoxy, MOE, and cEt | 28 | 9151 | 9166 | 4802 |
| 562363 | N/A | N/A | TGTGTTAAGTATTCCT | Deoxy, MOE, and cEt | 50 | 9157 | 9172 | 4803 |

TABLE 154-continued

Inhibition of ANGPTL3 mRNA by oligonucleotides targeting SEQ ID NO: 1 and 2

| ISIS NO | SEQ ID NO: 1 Start Site | SEQ ID NO: 1 Stop Site | Sequence | Chemistry | % inhibition | SEQ ID NO: 2 Start Site | SEQ ID NO: 2 Stop Site | SEQ ID NO |
|---|---|---|---|---|---|---|---|---|
| 562364 | N/A | N/A | AAGAGATGTGTTAAGT | Deoxy, MOE, and cEt | 21 | 9163 | 9178 | 4804 |
| 562365 | N/A | N/A | ACAGTCAAGAGATGTG | Deoxy, MOE, and cEt | 74 | 9169 | 9184 | 197 |
| 562366 | N/A | N/A | CCATATACAGTCAAGA | Deoxy, MOE, and cEt | 49 | 9175 | 9190 | 4805 |
| 562367 | N/A | N/A | TAACATCCATATACAG | Deoxy, MOE, and cEt | 16 | 9181 | 9196 | 4806 |
| 562368 | N/A | N/A | CTATTTATTAACATCC | Deoxy, MOE, and cEt | 2 | 9189 | 9204 | 4807 |
| 562369 | N/A | N/A | TGTCAGCTATTTATTA | Deoxy, MOE, and cEt | 22 | 9195 | 9210 | 4808 |
| 562370 | N/A | N/A | CTTTACTGTCAGCTAT | Deoxy, MOE, and cEt | 56 | 9201 | 9216 | 4809 |
| 562371 | N/A | N/A | GATAAACTTTACTGTC | Deoxy, MOE, and cEt | 37 | 9207 | 9222 | 4810 |
| 562372 | N/A | N/A | CTTTATATGGATAAAC | Deoxy, MOE, and cEt | 31 | 9216 | 9231 | 4811 |
| 562373 | N/A | N/A | GCAAGTCTTTATATGG | Deoxy, MOE, and cEt | 62 | 9222 | 9237 | 4812 |
| 560990 | 709 | 724 | TTCTTGGTGCTCTTGG | Deoxy, MOE, and cEt | 74 | 6722 | 6737 | 111 |
| 337487 | 804 | 823 | CACTTGTATGTTCACCTCTG | 5-10-5 MOE | 30 | 7389 | 7408 | 28 |
| 233717 | 889 | 908 | TGAATTAATGTCCATGGACT | 5-10-5 MOE | 38 | 7876 | 7895 | 14 |

Example 121

Antisense Inhibition of Human ANGPTL3 in Hep3B Cells by MOE Gapmers

Additional antisense oligonucleotides were designed targeting an ANGPTL3 nucleic acid and were tested for their effects on ANGPTL3 mRNA in vitro. Cultured Hep3B cells at a density of 20,000 cells per well were transfected using electroporation with 4,500 nM antisense oligonucleotide. After a treatment period of approximately 24 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The newly designed chimeric antisense oligonucleotides in the Tables below were designed as 5-10-5 MOE or 3-10-4 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The 3-10-4 MOE gapmers are 17 nucleosides in length, wherein the central gap segment comprises of ten 2'-deoxynucleosides and is flanked by wing segments on the 5' direction and the 3' direction comprising three and four nucleosides respectively. Each nucleoside in the 5' wing segment and each nucleoside in the 3' wing segment has a 2'-MOE modification. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either the human ANGPTL3 mRNA, designated herein as SEQ ID NO: 1 (GENBANK Accession No. NM_014495.2) or the human ANGPTL3 genomic sequence, designated herein as SEQ ID NO: 2 (GENBANK Accession No. NT_032977.9 truncated from nucleotides 33032001 to 33046000). 'n/a' indicates that the antisense oligonucleotide does not target that particular gene sequence with 100% complementarity.

TABLE 155

Inhibition of ANGPTL3 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 582715 | N/A | N/A | CTGGGTATTACTCTTTTCTA | 5-10-5 | 60 | 5931 | 5950 | 4813 |
| 582716 | N/A | N/A | CTTGCTGGGTATTACTCTTT | 5-10-5 | 59 | 5935 | 5954 | 4814 |
| 582717 | N/A | N/A | TGCTTGCTGGGTATTACTCT | 5-10-5 | 59 | 5937 | 5956 | 4815 |
| 582718 | N/A | N/A | CATGAATGATATTTCCTAGG | 5-10-5 | 39 | 5987 | 6006 | 4816 |
| 582719 | N/A | N/A | GGCATGAATGATATTTCCTA | 5-10-5 | 60 | 5989 | 6008 | 4817 |
| 582720 | N/A | N/A | CTGGCATGAATGATATTTCC | 5-10-5 | 46 | 5991 | 6010 | 4818 |
| 582721 | N/A | N/A | TGCTGGCATGAATGATATTT | 5-10-5 | 32 | 5993 | 6012 | 4819 |
| 582722 | N/A | N/A | AAGTCCATATTTGTATTTCT | 5-10-5 | 50 | 6962 | 6981 | 4820 |
| 582723 | N/A | N/A | GCAAATGTAGCATTTTTCA | 5-10-5 | 32 | 7246 | 7265 | 4821 |
| 582724 | N/A | N/A | GGCAAATGTAGCATTTTTC | 5-10-5 | 55 | 7247 | 7266 | 4822 |
| 582725 | N/A | N/A | GTGGCAAATGTAGCATTTTT | 5-10-5 | 62 | 7249 | 7268 | 203 |
| 582726 | N/A | N/A | CTGGTCCTTTTAACTTCCAA | 5-10-5 | 40 | 8366 | 8385 | 4823 |
| 582727 | N/A | N/A | CCTGGTCCTTTTAACTTCCA | 5-10-5 | 58 | 8367 | 8386 | 4824 |
| 582728 | N/A | N/A | TTCCTGGTCCTTTTAACTTC | 5-10-5 | 32 | 8369 | 8388 | 4825 |
| 582729 | N/A | N/A | TGCTTAATGTATGCTTTCTT | 5-10-5 | 51 | 9079 | 9098 | 4826 |

TABLE 155-continued

Inhibition of ANGPTL3 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 582730 | N/A | N/A | CCGTAAGTTTATCTTCCTTT | 5-10-5 | 58 | 10136 | 10155 | 4827 |
| 582731 | N/A | N/A | CCCCGTAAGTTTATCTTCCT | 5-10-5 | 51 | 10138 | 10157 | 4828 |
| 582732 | N/A | N/A | CACAAATATGTTCATTCTTA | 5-10-5 | 22 | 11189 | 11208 | 4829 |
| 582733 | N/A | N/A | GCCACAAATATGTTCATTCT | 5-10-5 | 71 | 11191 | 11210 | 204 |
| 582734 | N/A | N/A | AAACTTTAACTCGATGCCAC | 5-10-5 | 51 | 11206 | 11225 | 4830 |
| 582735 | N/A | N/A | ATAAACTTTAACTCGATGCC | 5-10-5 | 57 | 11208 | 11227 | 4831 |
| 582736 | N/A | N/A | ATGCTTGTCAGGCTGTTTAA | 5-10-5 | 56 | 11311 | 11330 | 4832 |
| 582737 | N/A | N/A | GTCACCATATAACTTGGGCA | 5-10-5 | 48 | 11562 | 11581 | 4833 |
| 582738 | N/A | N/A | AGGTCACCATATAACTTGGG | 5-10-5 | 44 | 11564 | 11583 | 4834 |
| 582766 | N/A | N/A | GCTGGGTATTACTCTTT | 3-10-4 | 55 | 5935 | 5951 | 4835 |
| 582767 | N/A | N/A | GCATGAATGATATTTCC | 3-10-4 | 4 | 5991 | 6007 | 4836 |
| 582768 | N/A | N/A | GGCAAATGTAGCATTTT | 3-10-4 | 33 | 7250 | 7266 | 4837 |
| 582769 | N/A | N/A | CTGGTCCTTTTAACTTC | 3-10-4 | 29 | 8369 | 8385 | 4838 |
| 582770 | N/A | N/A | GTAAGTTTATCTTCCTT | 3-10-4 | 26 | 10137 | 10153 | 4839 |
| 582771 | N/A | N/A | ACTTTAACTCGATGCCA | 3-10-4 | 42 | 11207 | 11223 | 4840 |
| 582772 | N/A | N/A | AACTTTAACTCGATGCC | 3-10-4 | 55 | 11208 | 11224 | 4841 |
| 582773 | N/A | N/A | AAACTTTAACTCGATGC | 3-10-4 | 1 | 11209 | 11225 | 4842 |
| 582774 | N/A | N/A | GCTTGTCAGGCTGTTTA | 3-10-4 | 65 | 11312 | 11328 | 208 |
| 582775 | N/A | N/A | CACCATATAACTTGGGC | 3-10-4 | 38 | 11563 | 11579 | 4843 |
| 582776 | N/A | N/A | TCACCATATAACTTGGG | 3-10-4 | 37 | 11564 | 11580 | 4844 |
| 582777 | N/A | N/A | GTCACCATATAACTTGG | 3-10-4 | 31 | 11565 | 11581 | 4845 |
| 582702 | 139 | 158 | CTTGATTTTGGCTCTGGAGA | 5-10-5 | 53 | 3243 | 3262 | 4846 |
| 582739 | 140 | 156 | TGATTTTGGCTCTGGAG | 3-10-4 | 41 | 3244 | 3260 | 4847 |
| 582703 | 141 | 160 | ATCTTGATTTTGGCTCTGGA | 5-10-5 | 64 | 3245 | 3264 | 198 |
| 582740 | 305 | 321 | ACTGGTTTGCAGCGATA | 3-10-4 | 58 | 3409 | 3425 | 4848 |
| 582704 | 306 | 325 | TTTCACTGGTTTGCAGCGAT | 5-10-5 | 60 | 3410 | 3429 | 4849 |
| 582741 | 306 | 322 | CACTGGTTTGCAGCGAT | 3-10-4 | 57 | 3410 | 3426 | 4850 |
| 582742 | 307 | 323 | TCACTGGTTTGCAGCGA | 3-10-4 | 60 | 3411 | 3427 | 4851 |
| 582705 | 706 | 725 | GTTCTTGGTGCTCTTGGCTT | 5-10-5 | 78 | 6719 | 6738 | 199 |
| 544120 | 707 | 726 | AGTTCTTGGTGCTCTTGGCT | 5-10-5 | 75 | 6720 | 6739 | 15 |
| 582743 | 707 | 723 | TCTTGGTGCTCTTGGCT | 3-10-4 | 63 | 6720 | 6736 | 205 |
| 582706 | 708 | 727 | TAGTTCTTGGTGCTCTTGGC | 5-10-5 | 69 | 6721 | 6740 | 200 |
| 582744 | 708 | 724 | TTCTTGGTGCTCTTGGC | 3-10-4 | 51 | 6721 | 6737 | 4852 |
| 582745 | 709 | 725 | GTTCTTGGTGCTCTTGG | 3-10-4 | 50 | 6722 | 6738 | 4853 |
| 337487 | 804 | 823 | CACTTGTATGTTCACCTCTG | 5-10-5 | 25 | 7389 | 7408 | 28 |
| 233717 | 889 | 908 | TGAATTAATGTCCATGGACT | 5-10-5 | 22 | 7876 | 7895 | 14 |
| 582707 | 1054 | 1073 | TTGTCTTTCCAGTCTTCCAA | 5-10-5 | 42 | 9629 | 9648 | 4854 |
| 582708 | 1056 | 1075 | TGTTGTCTTTCCAGTCTTCC | 5-10-5 | 52 | 9631 | 9650 | 4855 |
| 582746 | 1140 | 1156 | CATTGCCAGTAATCGCA | 3-10-4 | 53 | 9715 | 9731 | 4856 |
| 582747 | 1141 | 1157 | ACATTGCCAGTAATCGC | 3-10-4 | 61 | 9716 | 9732 | 4857 |
| 582748 | 1142 | 1158 | GACATTGCCAGTAATCG | 3-10-4 | 34 | 9717 | 9733 | 4858 |
| 582709 | 1194 | 1213 | CTTTGTGATCCCAAGTAGAA | 5-10-5 | 28 | 9769 | 9788 | 4859 |
| 582749 | 1195 | 1211 | TTGTGATCCCAAGTAGA | 3-10-4 | 16 | 9770 | 9786 | 4860 |
| 582710 | 1196 | 1215 | TGCTTTGTGATCCCAAGTAG | 5-10-5 | 54 | 9771 | 9790 | 4861 |
| 582750 | 1196 | 1212 | TTTGTGATCCCAAGTAG | 3-10-4 | 19 | 9771 | 9787 | 4862 |
| 582751 | 1197 | 1213 | CTTTGTGATCCCAAGTA | 3-10-4 | 32 | 9772 | 9788 | 4863 |
| 582752 | 1260 | 1276 | CACACTCATCATGCCAC | 3-10-4 | 42 | 10232 | 10248 | 4864 |
| 582711 | 1268 | 1287 | GTTGTTTTCTCCACACTCAT | 5-10-5 | 51 | 10240 | 10259 | 4865 |
| 582712 | 1270 | 1289 | AGGTTGTTTTCTCCACACTC | 5-10-5 | 63 | 10242 | 10261 | 201 |
| 582753 | 1307 | 1323 | AGATTTTGCTCTTGGTT | 3-10-4 | 54 | 10279 | 10295 | 4866 |
| 582754 | 1308 | 1324 | TAGATTTTGCTCTTGGT | 3-10-4 | 52 | 10280 | 10296 | 4867 |
| 582755 | 1309 | 1325 | TTAGATTTTGCTCTTGG | 3-10-4 | 44 | 10281 | 10297 | 4868 |
| 582756 | 1310 | 1326 | CTTAGATTTTGCTCTTG | 3-10-4 | 34 | 10282 | 10298 | 4869 |
| 567320 | 1487 | 1506 | CCAGATTATTAGACCACATT | 5-10-5 | 77 | 10459 | 10478 | 93 |
| 582757 | 1488 | 1504 | AGATTATTAGACCACAT | 3-10-4 | 0 | 10460 | 10476 | 4870 |
| 582758 | 1489 | 1505 | CAGATTATTAGACCACA | 3-10-4 | 39 | 10461 | 10477 | 4871 |
| 582759 | 1490 | 1506 | CCAGATTATTAGACCAC | 3-10-4 | 63 | 10462 | 10478 | 206 |
| 582760 | 1491 | 1507 | ACCAGATTATTAGACCA | 3-10-4 | 31 | 10463 | 10479 | 4872 |
| 582761 | 1763 | 1779 | GCTCATATGATGCCTTT | 3-10-4 | 71 | 10735 | 10751 | 207 |
| 582713 | 1906 | 1925 | ACACATACTCTGTGCTGACG | 5-10-5 | 68 | 10878 | 10897 | 202 |
| 582762 | 1907 | 1923 | ACATACTCTGTGCTGAC | 3-10-4 | 57 | 10879 | 10895 | 4873 |
| 582714 | 1908 | 1927 | TTACACATACTCTGTGCTGA | 5-10-5 | 49 | 10880 | 10899 | 4874 |
| 582763 | 2071 | 2087 | CTTAGTAGTCATCTCCA | 3-10-4 | 49 | 11043 | 11059 | 4875 |
| 582764 | 2072 | 2088 | ACTTAGTAGTCATCTCC | 3-10-4 | 53 | 11044 | 11060 | 4876 |
| 582765 | 2073 | 2089 | GACTTAGTAGTCATCTC | 3-10-4 | 36 | 11045 | 11061 | 4877 |

Example 122

Dose-Dependent Antisense Inhibition of Human ANGPTL3 in Hep3B Cells

Deoxy, MOE, and cEt oligonucleotides from the studies described above exhibiting significant in vitro inhibition of ANGPTL3 mRNA were selected and tested at various doses in Hep3B cells. ISIS 233717 and ISIS 337847, both 5-10-5 MOE gapmers, were also included in the studies. The antisense oligonucleotides were tested in a series of experiments that had similar culture conditions. The results of each experiment are presented in separate tables below.

Cells were plated at a density of 20,000 cells per well and transfected using electroporation with 0.813 µM, 1.625 µM, 3.25 µM, 6.500 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration ($IC_{50}$) of each oligonucleotide is also presented. ANGPTL3 mRNA levels were significantly reduced in a dose-dependent manner in antisense oligonucleotide treated cells.

TABLE 156

| ISIS No | 0.813 µM | 1.625 µM | 3.25 µM | 6.50 µM | 13.00 µM | $IC_{50}$ (µM) | SEQ ID NO |
|---|---|---|---|---|---|---|---|
| 233717 | 0 | 27 | 43 | 66 | 79 | 4.4 | 14 |
| 337487 | 26 | 49 | 63 | 85 | 94 | 2.0 | 28 |
| 559277 | 54 | 68 | 70 | 82 | 91 | <0.8 | 110 |
| 560990 | 36 | 61 | 74 | 90 | 96 | 1.2 | 111 |
| 560992 | 60 | 67 | 76 | 81 | 93 | <0.8 | 112 |
| 561010 | 71 | 77 | 82 | 86 | 94 | <0.8 | 113 |
| 561011 | 80 | 87 | 91 | 95 | 97 | <0.8 | 114 |
| 561022 | 75 | 79 | 84 | 89 | 93 | <0.8 | 115 |
| 561025 | 68 | 82 | 81 | 91 | 96 | <0.8 | 116 |
| 561026 | 72 | 85 | 85 | 89 | 90 | <0.8 | 117 |
| 561208 | 63 | 80 | 87 | 92 | 93 | <0.8 | 118 |
| 561320 | 47 | 60 | 86 | 92 | 96 | 0.8 | 119 |
| 561343 | 45 | 59 | 79 | 86 | 93 | 0.9 | 120 |
| 561345 | 38 | 59 | 80 | 88 | 95 | 1.1 | 121 |
| 561347 | 53 | 63 | 84 | 88 | 97 | <0.8 | 122 |

TABLE 157

| ISIS No | 0.813 µM | 1.625 µM | 3.25 µM | 6.50 µM | 13.00 µM | $IC_{50}$ (µM) | SEQ ID NO |
|---|---|---|---|---|---|---|---|
| 233717 | 7 | 19 | 55 | 60 | 77 | 4.2 | 14 |
| 337487 | 33 | 44 | 69 | 83 | 88 | 2.0 | 28 |
| 560990 | 36 | 64 | 81 | 87 | 95 | 1.1 | 111 |
| 561452 | 58 | 69 | 75 | 85 | 88 | <0.8 | 123 |
| 561458 | 69 | 77 | 84 | 91 | 94 | <0.8 | 124 |
| 561460 | 54 | 50 | 72 | 79 | 85 | <0.8 | 125 |
| 561462 | 49 | 72 | 80 | 90 | 92 | <0.8 | 126 |
| 561463 | 63 | 79 | 84 | 92 | 93 | <0.8 | 127 |
| 561478 | 56 | 53 | 80 | 86 | 91 | <0.8 | 128 |
| 561482 | 46 | 69 | 80 | 86 | 91 | <0.8 | 129 |
| 561486 | 56 | 73 | 80 | 91 | 92 | <0.8 | 130 |
| 561487 | 82 | 87 | 88 | 90 | 93 | <0.8 | 131 |
| 561500 | 52 | 60 | 71 | 80 | 91 | <0.8 | 132 |
| 561504 | 49 | 72 | 85 | 91 | 93 | <0.8 | 133 |
| 561621 | 68 | 76 | 85 | 91 | 94 | <0.8 | 134 |

TABLE 158

| ISIS No | 0.813 µM | 1.625 µM | 3.25 µM | 6.50 µM | 13.00 µM | $IC_{50}$ (µM) | SEQ ID NO |
|---|---|---|---|---|---|---|---|
| 233717 | 28 | 35 | 48 | 56 | 60 | 4.7 | 14 |
| 337487 | 43 | 58 | 72 | 82 | 89 | 1.0 | 28 |
| 560990 | 57 | 73 | 82 | 86 | 96 | <0.8 | 111 |
| 561620 | 51 | 74 | 80 | 85 | 88 | <0.8 | 135 |
| 561622 | 63 | 73 | 85 | 88 | 87 | <0.8 | 136 |
| 561628 | 48 | 69 | 77 | 79 | 80 | <0.8 | 137 |
| 561631 | 60 | 75 | 84 | 86 | 90 | <0.8 | 138 |
| 561644 | 59 | 69 | 77 | 85 | 83 | <0.8 | 139 |
| 561646 | 67 | 81 | 84 | 91 | 92 | <0.8 | 140 |
| 561649 | 70 | 76 | 85 | 89 | 89 | <0.8 | 141 |
| 561650 | 78 | 85 | 88 | 90 | 91 | <0.8 | 142 |
| 561770 | 66 | 81 | 79 | 88 | 91 | <0.8 | 143 |
| 561781 | 65 | 67 | 80 | 81 | 91 | <0.8 | 144 |
| 561791 | 68 | 73 | 83 | 82 | 85 | <0.8 | 145 |
| 561918 | 63 | 71 | 81 | 86 | 92 | <0.8 | 146 |

TABLE 159

| ISIS No | 0.813 µM | 1.625 µM | 3.25 µM | 6.50 µM | 13.00 µM | $IC_{50}$ (µM) | SEQ ID NO |
|---|---|---|---|---|---|---|---|
| 233717 | 21 | 26 | 47 | 62 | 69 | 4.2 | 14 |
| 337487 | 35 | 54 | 73 | 82 | 92 | 1.0 | 28 |
| 560990 | 42 | 76 | 81 | 88 | 96 | <0.8 | 111 |
| 562078 | 55 | 85 | 86 | 91 | 93 | <0.8 | 147 |
| 562086 | 64 | 83 | 87 | 92 | 93 | <0.8 | 148 |
| 562103 | 72 | 83 | 90 | 90 | 94 | <0.8 | 149 |
| 562110 | 66 | 80 | 83 | 89 | 92 | <0.8 | 150 |
| 562375 | 56 | 61 | 63 | 84 | 90 | <0.8 | 151 |
| 562387 | 67 | 75 | 81 | 90 | 88 | <0.8 | 152 |
| 562396 | 60 | 71 | 80 | 80 | 85 | <0.8 | 153 |
| 562415 | 66 | 73 | 77 | 77 | 81 | <0.8 | 154 |
| 562433 | 68 | 84 | 86 | 90 | 91 | <0.8 | 155 |
| 562436 | 78 | 87 | 87 | 91 | 94 | <0.8 | 156 |
| 562439 | 55 | 66 | 78 | 82 | 93 | <0.8 | 157 |
| 562442 | 55 | 57 | 60 | 76 | 86 | <0.8 | 158 |

Example 123

Dose-Dependent Antisense Inhibition of Human ANGPTL3 in Hep3B Cells

Deoxy, MOE, and cEt oligonucleotides from the studies described above exhibiting significant in vitro inhibition of ANGPTL3 mRNA were selected and tested at various doses in Hep3B cells. ISIS 337847, a 5-10-5 MOE gapmer, was also included in the studies. The antisense oligonucleotides were tested in a series of experiments that had similar culture conditions. The results of each experiment are presented in separate tables below.

Cells were plated at a density of 20,000 cells per well and transfected using electroporation with 0.160 µM, 0.481 µM, 1.444 µM, 4.333 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration ($IC_{50}$) of each oligonucleotide is also presented. ANGPTL3 mRNA levels were significantly reduced in a dose-dependent manner in antisense oligonucleotide treated cells.

TABLE 160

| ISIS No | 0.160 µM | 0.481 µM | 1.444 µM | 4.333 µM | 13.00 µM | IC$_{50}$ (µM) | SEQ ID NO |
|---|---|---|---|---|---|---|---|
| 337487 | 0 | 18 | 24 | 49 | 73 | 4.1 | 28 |
| 560990 | 2 | 27 | 39 | 59 | 80 | 2.0 | 111 |
| 561076 | 20 | 33 | 59 | 73 | 89 | 1.1 | 159 |
| 561079 | 24 | 39 | 51 | 72 | 84 | 1.0 | 160 |
| 561084 | 7 | 17 | 46 | 66 | 87 | 1.9 | 161 |
| 561085 | 21 | 35 | 55 | 69 | 86 | 1.2 | 162 |
| 561123 | 20 | 39 | 52 | 72 | 87 | 1.1 | 163 |
| 561241 | 13 | 22 | 41 | 68 | 86 | 2.0 | 164 |
| 561256 | 12 | 22 | 35 | 54 | 82 | 2.6 | 165 |
| 561260 | 22 | 16 | 34 | 54 | 82 | 2.6 | 166 |
| 561277 | 21 | 21 | 37 | 59 | 69 | 2.9 | 167 |
| 561288 | 6 | 8 | 23 | 36 | 68 | 6.9 | 168 |
| 561418 | 25 | 36 | 61 | 79 | 86 | 0.9 | 169 |
| 561436 | 21 | 40 | 61 | 77 | 88 | 0.9 | 170 |
| 561443 | 18 | 32 | 52 | 82 | 88 | 1.1 | 171 |

TABLE 161

| ISIS No | 0.160 µM | 0.481 µM | 1.444 µM | 4.333 µM | 13.00 µM | IC$_{50}$ (µM) | SEQ ID NO |
|---|---|---|---|---|---|---|---|
| 337487 | 0 | 8 | 21 | 52 | 81 | 3.7 | 28 |
| 560990 | 6 | 14 | 40 | 61 | 74 | 3.0 | 111 |
| 561398 | 3 | 9 | 22 | 64 | 79 | 3.0 | 172 |
| 561400 | 11 | 28 | 50 | 65 | 83 | 1.7 | 173 |
| 561528 | 2 | 39 | 59 | 74 | 84 | 1.3 | 174 |
| 561565 | 18 | 43 | 58 | 75 | 83 | 1.0 | 175 |
| 561566 | 21 | 29 | 54 | 71 | 79 | 1.4 | 176 |
| 561567 | 16 | 35 | 56 | 67 | 78 | 1.4 | 177 |
| 561571 | 18 | 32 | 60 | 80 | 86 | 1.1 | 178 |
| 561576 | 11 | 12 | 42 | 65 | 77 | 2.4 | 179 |
| 561689 | 16 | 27 | 52 | 76 | 80 | 1.4 | 180 |
| 561698 | 1 | 24 | 31 | 61 | 74 | 2.9 | 181 |
| 561699 | 2 | 19 | 48 | 65 | 81 | 2.0 | 182 |
| 561722 | 14 | 34 | 59 | 72 | 85 | 1.2 | 183 |
| 561723 | 7 | 31 | 69 | 71 | 75 | 1.4 | 184 |

TABLE 162

| ISIS No | 0.160 µM | 0.481 µM | 1.444 µM | 4.333 µM | 13.00 µM | IC$_{50}$ (µM) | SEQ ID NO |
|---|---|---|---|---|---|---|---|
| 337487 | 14 | 9 | 9 | 47 | 72 | 5.9 | 28 |
| 560990 | 13 | 26 | 39 | 58 | 81 | 2.0 | 111 |
| 561888 | 16 | 19 | 46 | 72 | 84 | 1.7 | 185 |
| 561897 | 6 | 31 | 50 | 67 | 82 | 2.0 | 186 |
| 561996 | 19 | 31 | 49 | 59 | 83 | 1.6 | 187 |
| 562001 | 22 | 46 | 57 | 67 | 89 | 0.9 | 188 |
| 562024 | 17 | 29 | 59 | 71 | 83 | 1.3 | 189 |
| 562050 | 21 | 38 | 46 | 62 | 74 | 1.6 | 190 |
| 562153 | 22 | 35 | 42 | 61 | 71 | 2.0 | 191 |
| 562155 | 29 | 29 | 50 | 72 | 84 | 1.2 | 192 |
| 562156 | 15 | 17 | 39 | 60 | 82 | 2.3 | 193 |
| 562157 | 14 | 15 | 43 | 54 | 75 | 3.0 | 194 |
| 562181 | 24 | 34 | 58 | 73 | 80 | 1.1 | 195 |
| 562314 | 22 | 30 | 42 | 54 | 64 | 3.1 | 196 |
| 562365 | 25 | 27 | 46 | 64 | 77 | 1.7 | 197 |

Example 124

Dose-Dependent Antisense Inhibition of Human ANGPTL3 in Hep3B Cells by MOE Gapmers MOE gapmers from the Examples above exhibiting significant in vitro inhibition of ANGPTL3 mRNA were selected and tested at various doses in Hep3B cells. Cells were plated at a density of 20,000 cells per well and transfected using electroporation with 0.160 µM, 0.481 µM, 1.444 µM, 4.333 µM and 13.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 163

| ISIS No | Motif | 0.16 µM | 0.48 µM | 1.44 µM | 4.33 µM | 13.00 µM | IC$_{50}$ (µM) | SEQ ID NO |
|---|---|---|---|---|---|---|---|---|
| 233717 | 5-10-5 | 0 | 3 | 12 | 38 | 64 | 8.0 | 14 |
| 337487 | 5-10-5 | 0 | 0 | 15 | 30 | 66 | 8.0 | 28 |
| 544120 | 5-10-5 | 10 | 37 | 62 | 81 | 94 | 1.0 | 15 |
| 567320 | 5-10-5 | 0 | 30 | 67 | 84 | 95 | 1.1 | 93 |
| 582703 | 5-10-5 | 0 | 18 | 47 | 71 | 83 | 2.0 | 198 |
| 582705 | 5-10-5 | 22 | 18 | 46 | 82 | 93 | 1.0 | 199 |
| 582706 | 5-10-5 | 2 | 0 | 32 | 67 | 85 | 2.6 | 200 |
| 582712 | 5-10-5 | 0 | 0 | 54 | 71 | 89 | 2.2 | 201 |
| 582713 | 5-10-5 | 25 | 25 | 52 | 75 | 85 | 1.2 | 202 |
| 582725 | 5-10-5 | 0 | 3 | 43 | 62 | 84 | 2.7 | 203 |
| 582733 | 5-10-5 | 0 | 30 | 66 | 77 | 87 | 1.3 | 204 |
| 582743 | 3-10-4 | 0 | 6 | 37 | 51 | 87 | 2.9 | 205 |
| 582759 | 3-10-4 | 0 | 2 | 51 | 76 | 93 | 2.0 | 206 |
| 582761 | 3-10-4 | 4 | 38 | 58 | 72 | 87 | 1.3 | 207 |
| 582774 | 3-10-4 | 5 | 29 | 46 | 72 | 86 | 1.6 | 208 |

Example 125

Dose-Dependent Antisense Inhibition of Human ANGPTL3 in Hep3B Cells by Deoxy, MOE and cEt Oligonucleotides Deoxy, MOE, and cEt oligonucleotides from the studies described above exhibiting significant in vitro inhibition of ANGPTL3 mRNA were selected and tested at various doses in Hep3B cells. Cells were plated at a density of 20,000 cells per well and transfected using electroporation with 0.111 µM, 0.333 µM, 1.00 µM, 3.00 µM and 9.00 µM concentrations of antisense oligonucleotide, as specified in the Table below. After a treatment period of approximately 16 hours, RNA was isolated from the cells and ANGPTL3 mRNA levels were measured by quantitative real-time PCR. Human primer probe set RTS3492_MGB was used to measure mRNA levels. ANGPTL3 mRNA levels were adjusted according to total RNA content, as measured by RIBOGREEN®. Results are presented as percent inhibition of ANGPTL3, relative to untreated control cells.

The half maximal inhibitory concentration (IC$_{50}$) of each oligonucleotide is also presented. ANGPTL3 mRNA levels were significantly reduced in a dose-dependent manner in antisense oligonucleotide treated cells.

TABLE 164

| ISIS No | 0.111 µM | 0.333 µM | 1.00 µM | 3.00 µM | 9.00 µM | IC$_{50}$ (µM) | SEQ ID NO |
|---|---|---|---|---|---|---|---|
| 561011 | 20 | 39 | 65 | 81 | 94 | 0.5 | 114 |
| 561026 | 23 | 43 | 65 | 84 | 94 | 0.5 | 117 |
| 561463 | 26 | 25 | 59 | 76 | 91 | 0.7 | 127 |
| 561487 | 42 | 61 | 81 | 89 | 95 | 0.1 | 131 |
| 586661 | 24 | 36 | 46 | 76 | 92 | 0.7 | 209 |

TABLE 164-continued

| ISIS No | 0.111 µM | 0.333 µM | 1.00 µM | 3.00 µM | 9.00 µM | IC$_{50}$ (µM) | SEQ ID NO |
|---|---|---|---|---|---|---|---|
| 586669 | 31 | 50 | 68 | 85 | 95 | 0.3 | 210 |
| 586676 | 26 | 50 | 73 | 83 | 95 | 0.3 | 211 |
| 586688 | 4 | 24 | 51 | 82 | 91 | 0.9 | 212 |
| 586690 | 19 | 39 | 64 | 84 | 95 | 0.5 | 213 |
| 586691 | 6 | 37 | 60 | 81 | 93 | 0.7 | 214 |
| 586701 | 10 | 32 | 55 | 76 | 90 | 0.8 | 215 |
| 586702 | 16 | 25 | 55 | 69 | 86 | 0.9 | 216 |
| 586705 | 10 | 30 | 54 | 80 | 89 | 0.8 | 217 |
| 586707 | 33 | 42 | 71 | 83 | 89 | 0.3 | 218 |
| 586718 | 38 | 54 | 72 | 78 | 85 | 0.2 | 219 |

TABLE 165

| ISIS No | 0.111 µM | 0.333 µM | 1.00 µM | 3.00 µM | 9.00 µM | IC$_{50}$ (µM) | SEQ ID NO |
|---|---|---|---|---|---|---|---|
| 561011 | 13 | 29 | 41 | 76 | 89 | 1.0 | 114 |
| 561567 | 20 | 46 | 57 | 75 | 78 | 0.7 | 177 |
| 586692 | 32 | 30 | 71 | 85 | 95 | 0.4 | 220 |
| 586700 | 3 | 46 | 70 | 82 | 95 | 1.0 | 221 |
| 586708 | 36 | 46 | 62 | 77 | 86 | 0.4 | 222 |
| 586744 | 0 | 19 | 54 | 81 | 92 | 1.0 | 223 |
| 586745 | 35 | 22 | 66 | 78 | 92 | 0.5 | 224 |
| 586746 | 14 | 30 | 59 | 82 | 92 | 0.7 | 225 |
| 586755 | 18 | 22 | 53 | 74 | 90 | 0.9 | 226 |
| 586761 | 26 | 26 | 54 | 73 | 90 | 0.8 | 227 |
| 586787 | 0 | 38 | 64 | 79 | 90 | 0.8 | 228 |
| 586796 | 12 | 13 | 56 | 83 | 93 | 0.9 | 229 |
| 586797 | 4 | 26 | 58 | 82 | 90 | 0.9 | 230 |
| 586802 | 12 | 28 | 56 | 76 | 81 | 0.9 | 231 |
| 586804 | 17 | 40 | 65 | 86 | 93 | 0.5 | 232 |

TABLE 166

| ISIS No | 0.111 µM | 0.333 µM | 1.00 µM | 3.00 µM | 9.00 µM | IC$_{50}$ (µM) | SEQ ID NO |
|---|---|---|---|---|---|---|---|
| 561011 | 20 | 48 | 75 | 84 | 94 | 0.4 | 114 |
| 561026 | 31 | 48 | 70 | 88 | 95 | 0.3 | 117 |
| 561463 | 27 | 40 | 67 | 85 | 94 | 0.4 | 127 |
| 561487 | 41 | 66 | 84 | 91 | 95 | 0.1 | 131 |
| 586661 | 36 | 45 | 64 | 82 | 91 | 0.3 | 209 |
| 586669 | 21 | 55 | 73 | 90 | 96 | 0.3 | 210 |
| 586676 | 23 | 59 | 77 | 87 | 94 | 0.3 | 211 |
| 586688 | 25 | 41 | 70 | 82 | 93 | 0.4 | 212 |
| 586690 | 16 | 45 | 74 | 86 | 92 | 0.5 | 213 |
| 586691 | 13 | 40 | 65 | 86 | 92 | 0.6 | 214 |
| 586701 | 22 | 49 | 70 | 82 | 93 | 0.4 | 215 |
| 586702 | 11 | 31 | 58 | 76 | 92 | 0.8 | 216 |
| 586705 | 26 | 45 | 66 | 82 | 89 | 0.4 | 217 |
| 586707 | 28 | 58 | 75 | 85 | 88 | 0.3 | 218 |
| 586718 | 33 | 59 | 73 | 80 | 88 | 0.2 | 219 |

TABLE 167

| ISIS No | 0.111 µM | 0.333 µM | 1.00 µM | 3.00 µM | 9.00 µM | IC$_{50}$ (µM) | SEQ ID NO |
|---|---|---|---|---|---|---|---|
| 561011 | 23 | 41 | 63 | 82 | 92 | 0.5 | 114 |
| 561567 | 31 | 44 | 65 | 75 | 83 | 0.4 | 177 |
| 586692 | 16 | 58 | 74 | 89 | 93 | 0.4 | 220 |
| 586700 | 25 | 62 | 75 | 91 | 94 | 0.3 | 221 |
| 586708 | 36 | 53 | 72 | 81 | 90 | 0.3 | 222 |
| 586744 | 30 | 29 | 64 | 75 | 94 | 0.6 | 223 |
| 586745 | 21 | 44 | 59 | 81 | 89 | 0.5 | 224 |
| 586746 | 19 | 48 | 57 | 85 | 87 | 0.5 | 225 |
| 586755 | 6 | 30 | 59 | 78 | 89 | 0.8 | 226 |
| 586761 | 12 | 29 | 59 | 72 | 87 | 0.9 | 227 |
| 586787 | 27 | 35 | 64 | 84 | 97 | 0.5 | 228 |
| 586796 | 31 | 40 | 72 | 91 | 95 | 0.3 | 229 |
| 586797 | 36 | 47 | 67 | 82 | 88 | 0.3 | 230 |
| 586802 | 35 | 32 | 61 | 76 | 90 | 0.5 | 231 |
| 586804 | 35 | 50 | 75 | 91 | 91 | 0.2 | 232 |

Example 126

Antisense Inhibition of Human ANGPTL3 in huANGPTL3 Transgenic Mice

Antisense oligonucleotides described in the studies above were further evaluated for their ability to reduce human ANGPTL3 mRNA transcript in C57B1/6 mice with the human ANGPTL3 transgene (Tg mice).

Study 1

Female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 50 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with RTS3492_MGB. mRNA levels were also measured with human primer probe set RTS1984 (forward sequence CTTCAATGAAACGTGG-GAGAACT, designated herein as SEQ ID NO: 7; reverse sequence TCTCTAGGCCCAACCAAAATTC, designated herein as SEQ ID NO: 8; probe sequence AAATATG-GTTTTGGGAGGCTTGAT, designated herein as SEQ ID NO: 9). Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 168

Percent inhibition of ANGPTL3 mRNA in transgenic mouse liver relative to the PBS control

| ISIS No | RTS3492_MGB | RTS1984 | SEQ ID NO |
|---|---|---|---|
| 233710 | 91 | 94 | 233 |
| 233717 | 49 | 58 | 14 |
| 337477 | 76 | 82 | 234 |
| 337478 | 52 | 65 | 235 |
| 337479 | 53 | 76 | 236 |
| 337487 | 80 | 92 | 28 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with ISIS oligonucleotides resulted in reduced ANGPTL3 protein levels.

TABLE 169

Percent inhibition of plasma protein levels in the transgenic mouse

| ISIS No | % | SEQ ID NO |
|---|---|---|
| 233710 | 92 | 233 |
| 233717 | 47 | 14 |
| 337477 | 68 | 234 |
| 337478 | 36 | 235 |
| 337479 | 48 | 236 |
| 337487 | 78 | 28 |

Plasma Chemistry Markers

To evaluate the effect of ISIS oligonucleotides on day 10, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 170

Plasma transaminase levels (IU/L) in transgenic mice on day 10

|  | ALT | AST | SEQ ID NO |
|---|---|---|---|
| PBS | 27 | 36 |  |
| ISIS 233710 | 19 | 37 | 233 |
| ISIS 233717 | 16 | 32 | 14 |
| ISIS 337477 | 22 | 35 | 234 |
| ISIS 337478 | 23 | 49 | 235 |
| ISIS 337479 | 21 | 29 | 236 |
| ISIS 337487 | 19 | 35 | 28 |

Study 2

Male Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 50 mg/kg once per week for 2 weeks. One group of mice received subcutaneous injections of PBS once weekly for 2 weeks. The PBS-injected groups served as the control groups to which the corresponding oligonucleotide-treated groups were compared.

RNA Analysis

At the end of the treatment period, RNA was extracted from liver for real-time PCR analysis of measurement of mRNA expression of ANGPTL3 with RTS1984. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 171

Percent inhibition of ANGPTL3 mRNA in transgenic mouse liver relative to the PBS control

| ISIS No | % | SEQ ID NO |
|---|---|---|
| 233710 | 81 | 233 |
| 337487 | 92 | 28 |
| 544145 | 98 | 16 |
| 544162 | 75 | 18 |
| 544199 | 97 | 20 |
| 560306 | 90 | 34 |
| 560400 | 97 | 35 |
| 560401 | 95 | 36 |
| 560402 | 98 | 37 |
| 560469 | 98 | 38 |
| 560735 | 87 | 49 |
| 567320 | 95 | 93 |
| 567321 | 93 | 94 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with ISIS oligonucleotides resulted in reduced ANGPTL3 protein levels.

TABLE 172

Percent inhibition of plasma protein levels in the transgenic mouse

| ISIS No | % | SEQ ID NO |
|---|---|---|
| 233710 | 96 | 233 |
| 337487 | 78 | 28 |
| 544145 | 96 | 16 |
| 544162 | 97 | 18 |
| 544199 | 98 | 20 |
| 560306 | 97 | 34 |
| 560400 | 98 | 35 |
| 560401 | 97 | 36 |
| 560402 | 94 | 37 |
| 560469 | 96 | 38 |
| 560735 | 91 | 49 |
| 567320 | 98 | 93 |
| 567321 | 96 | 94 |

Plasma Chemistry Markers

To evaluate the effect of ISIS oligonucleotides on day 8, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 173

Plasma transaminase levels (IU/L) in transgenic mice on day 8

|  | ALT | AST | SEQ ID NO |
|---|---|---|---|
| PBS | 29 | 44 |  |
| ISIS 233710 | 29 | 47 | 233 |
| ISIS 337487 | 22 | 36 | 28 |
| ISIS 544145 | 29 | 45 | 16 |

TABLE 173-continued

Plasma transaminase levels (IU/L) in transgenic mice on day 8

| | ALT | AST | SEQ ID NO |
|---|---|---|---|
| ISIS 544162 | 31 | 62 | 18 |
| ISIS 544199 | 29 | 51 | 20 |
| ISIS 560306 | 23 | 42 | 34 |
| ISIS 560400 | 24 | 52 | 35 |
| ISIS 560401 | 20 | 38 | 36 |
| ISIS 560402 | 29 | 49 | 37 |
| ISIS 560469 | 22 | 50 | 38 |
| ISIS 560735 | 20 | 38 | 49 |
| ISIS 567320 | 49 | 71 | 93 |
| ISIS 567321 | 20 | 44 | 94 |

Study 3

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 2.5 mg/kg, 12.5 mg/kg, or 25 mg/kg once per week for 3 weeks. One group of mice received subcutaneous injections of PBS once weekly for 2 weeks. The PBS-injected groups served as the control groups to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022 (forward sequence AAATTTTAGC-CAATGGCCTCC, designated herein as SEQ ID NO: 10; reverse sequence TGTCATTAATTTGGCCCTTCG, designated herein as SEQ ID NO: 11; probe sequence TCAGT-TGGGACATGGTCTTAAAGACTTTGTCC, designated herein as SEQ ID NO: 12). Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control. The $ED_{50}$ of each gapmer is also presented in the Table below. 'n.d.' indicates that the $ED_{50}$ could not be determined.

TABLE 174

Percent inhibition of ANGPTL3 mRNA in transgenic mouse liver relative to the PBS control

| ISIS No | Dose (mg/kg) | % | $ED_{50}$ | SEQ ID NO |
|---|---|---|---|---|
| 233710 | 25 | 88 | 8 | 233 |
|  | 12.5 | 79 |  |  |
|  | 2.5 | 0 |  |  |
| 544145 | 25 | 90 | 4 | 16 |
|  | 12.5 | 74 |  |  |
|  | 2.5 | 39 |  |  |
| 544162 | 25 | 53 | 9 | 18 |
|  | 12.5 | 63 |  |  |
|  | 2.5 | 39 |  |  |
| 544199 | 25 | 81 | 7 | 20 |
|  | 12.5 | 82 |  |  |
|  | 2.5 | 7 |  |  |
| 560306 | 25 | 0 | n.d. | 34 |
|  | 12.5 | 0 |  |  |
|  | 2.5 | 0 |  |  |
| 560400 | 25 | 87 | 5 | 35 |
|  | 12.5 | 76 |  |  |
|  | 2.5 | 24 |  |  |
| 560401 | 25 | 89 | 8 | 36 |
|  | 12.5 | 62 |  |  |
|  | 2.5 | 5 |  |  |
| 560469 | 25 | 73 | 3 | 38 |
|  | 12.5 | 78 |  |  |
|  | 2.5 | 50 |  |  |
| 560735 | 25 | 26 | 31 | 49 |
|  | 12.5 | 37 |  |  |
|  | 2.5 | 51 |  |  |
| 567320 | 25 | 74 | 12 | 93 |
|  | 12.5 | 37 |  |  |
|  | 2.5 | 32 |  |  |
| 567321 | 25 | 75 | 11 | 94 |
|  | 12.5 | 61 |  |  |
|  | 2.5 | 0 |  |  |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with ISIS oligonucleotides resulted in reduced ANGPTL3 protein levels. 'n.d.' indicates that the $ED_{50}$ could not be determined

TABLE 175

Percent inhibition of plasma protein levels in the transgenic mouse

| ISIS No | Dose (mg/kg) | % | $ED_{50}$ | SEQ ID NO |
|---|---|---|---|---|
| 233710 | 25 | 80 | 11 | 233 |
|  | 12.5 | 56 |  |  |
|  | 2.5 | 0 |  |  |
| 544145 | 25 | 88 | 9 | 16 |
|  | 12.5 | 64 |  |  |
|  | 2.5 | 0 |  |  |
| 544162 | 25 | 56 | 15 | 18 |
|  | 12.5 | 46 |  |  |
|  | 2.5 | 24 |  |  |
| 544199 | 25 | 73 | 6 | 20 |
|  | 12.5 | 73 |  |  |
|  | 2.5 | 31 |  |  |
| 560306 | 25 | 63 | n.d. | 34 |
|  | 12.5 | 55 |  |  |
|  | 2.5 | 53 |  |  |
| 560400 | 25 | 88 | 6 | 35 |
|  | 12.5 | 73 |  |  |
|  | 2.5 | 20 |  |  |
| 560401 | 25 | 88 | 10 | 36 |
|  | 12.5 | 61 |  |  |
|  | 2.5 | 0 |  |  |
| 560469 | 25 | 75 | 4 | 38 |
|  | 12.5 | 70 |  |  |
|  | 2.5 | 52 |  |  |
| 560735 | 25 | 27 | 34 | 49 |
|  | 12.5 | 37 |  |  |
|  | 2.5 | 34 |  |  |
| 567320 | 25 | 69 | 10 | 93 |
|  | 12.5 | 44 |  |  |
|  | 2.5 | 39 |  |  |

TABLE 175-continued

Percent inhibition of plasma protein levels in the transgenic mouse

| ISIS No | Dose (mg/kg) | % | ED₅₀ | SEQ ID NO |
|---|---|---|---|---|
| 567321 | 25 | 68 | 12 | 94 |
| | 12.5 | 62 | | |
| | 2.5 | 1 | | |

Plasma Chemistry Markers

To evaluate the effect of ISIS oligonucleotides on day 17, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 176

Plasma transaminase levels (IU/L) in transgenic mice on day 17

| | Dose (mg/kg) | ALT | AST | SEQ ID NO |
|---|---|---|---|---|
| PBS | — | 25 | 38 | |
| ISIS 233710 | 25 | 27 | 40 | 233 |
| | 12.5 | 24 | 45 | |
| | 2.5 | 23 | 36 | |
| ISIS 544145 | 25 | 30 | 56 | 16 |
| | 12.5 | 25 | 52 | |
| | 2.5 | 28 | 43 | |
| ISIS 544162 | 25 | 28 | 52 | 18 |
| | 12.5 | 36 | 53 | |
| | 2.5 | 28 | 50 | |
| ISIS 544199 | 25 | 24 | 47 | 20 |
| | 12.5 | 23 | 60 | |
| | 2.5 | 24 | 44 | |
| ISIS 560306 | 25 | 21 | 45 | 34 |
| | 12.5 | 24 | 49 | |
| | 2.5 | 24 | 47 | |
| ISIS 560400 | 25 | 22 | 38 | 35 |
| | 12.5 | 21 | 53 | |
| | 2.5 | 23 | 52 | |
| ISIS 560401 | 25 | 36 | 80 | 36 |
| | 12.5 | 27 | 75 | |
| | 2.5 | 22 | 49 | |
| ISIS 560469 | 25 | 24 | 121 | 38 |
| | 12.5 | 23 | 53 | |
| | 2.5 | 21 | 88 | |
| ISIS 560735 | 25 | 20 | 48 | 49 |
| | 12.5 | 22 | 138 | |
| | 2.5 | 24 | 78 | |
| ISIS 567320 | 25 | 21 | 65 | 93 |
| | 12.5 | 20 | 58 | |
| | 2.5 | 23 | 46 | |
| ISIS 567321 | 25 | 23 | 62 | 94 |
| | 12.5 | 21 | 49 | |
| | 2.5 | 24 | 67 | |

Study 4

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers at a dose of 25 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 177

Percent inhibition of ANGPTL3 mRNA in transgenic mouse liver relative to the PBS control

| ISIS No | % | SEQ ID NO |
|---|---|---|
| 233710 | 68 | 233 |
| 544120 | 63 | 15 |
| 544199 | 82 | 20 |
| 544355 | 0 | 21 |
| 560268 | 36 | 32 |
| 560470 | 47 | 39 |
| 560471 | 67 | 40 |
| 560474 | 57 | 41 |
| 560566 | 45 | 42 |
| 560567 | 68 | 43 |
| 560607 | 37 | 46 |
| 560608 | 15 | 47 |
| 560744 | 25 | 51 |
| 560778 | 32 | 52 |
| 560811 | 27 | 54 |
| 560925 | 0 | 56 |
| 563639 | 5 | 79 |
| 567291 | 8 | 91 |
| 567330 | 30 | 95 |
| 568049 | 48 | 101 |
| 568146 | 26 | 104 |

Plasma Chemistry Markers

To evaluate the effect of ISIS oligonucleotides on day 10, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 178

Plasma transaminase levels (IU/L) in transgenic mice on day 10

| | ALT | AST | SEQ ID NO |
|---|---|---|---|
| PBS | 29 | 41 | |
| ISIS 233710 | 29 | 48 | 233 |
| ISIS 544120 | 24 | 35 | 15 |
| ISIS 544199 | 27 | 57 | 20 |
| ISIS 544355 | 23 | 44 | 21 |
| ISIS 560268 | 23 | 42 | 32 |
| ISIS 560470 | 26 | 42 | 39 |
| ISIS 560471 | 21 | 50 | 40 |
| ISIS 560474 | 20 | 33 | 41 |
| ISIS 560566 | 27 | 102 | 42 |
| ISIS 560567 | 20 | 37 | 43 |
| ISIS 560607 | 25 | 47 | 46 |
| ISIS 560608 | 20 | 49 | 47 |
| ISIS 560744 | 26 | 66 | 51 |
| ISIS 560778 | 24 | 87 | 52 |

TABLE 178-continued

Plasma transaminase levels (IU/L) in transgenic mice on day 10

|  | ALT | AST | SEQ ID NO |
|---|---|---|---|
| ISIS 560811 | 21 | 63 | 54 |
| ISIS 560925 | 25 | 115 | 56 |
| ISIS 563639 | 20 | 43 | 79 |
| ISIS 567291 | 20 | 67 | 91 |
| ISIS 567330 | 29 | 78 | 95 |
| ISIS 568049 | 25 | 63 | 101 |
| ISIS 568146 | 28 | 140 | 104 |

Study 5

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers or deoxy, MOE, and cEt gapmers at a dose of 25 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with RTS1984. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 179

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 79 | 233 |
| 544156 | 5-10-5 MOE | 92 | 17 |
| 559277 | Deoxy, MOE and cEt | 75 | 110 |
| 560265 | 5-10-5 MOE | 52 | 31 |
| 560285 | 5-10-5 MOE | 42 | 33 |
| 560574 | 5-10-5 MOE | 93 | 44 |
| 560847 | 5-10-5 MOE | 61 | 69 |
| 560992 | Deoxy, MOE and cEt | 80 | 112 |
| 561010 | Deoxy, MOE and cEt | 66 | 113 |
| 561011 | Deoxy, MOE and cEt | 96 | 114 |
| 561022 | Deoxy, MOE and cEt | 79 | 115 |
| 561025 | Deoxy, MOE and cEt | 57 | 116 |
| 563580 | 5-10-5 MOE | 80 | 77 |
| 567115 | 5-10-5 MOE | 78 | 88 |
| 567233 | 5-10-5 MOE | 91 | 90 |

Plasma Chemistry Markers

To evaluate the effect of ISIS oligonucleotides on day 9, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 180

Plasma transaminase levels (IU/L) in transgenic mice on day 9

|  | Chemistry | ALT | AST | SEQ ID NO |
|---|---|---|---|---|
| PBS | — | 48 | 65 |  |
| ISIS 233710 | 5-10-5 MOE | 24 | 43 | 233 |
| ISIS 544156 | 5-10-5 MOE | 29 | 44 | 17 |
| ISIS 559277 | Deoxy, MOE and cEt | 22 | 38 | 110 |
| ISIS 560265 | 5-10-5 MOE | 28 | 83 | 31 |
| ISIS 560285 | 5-10-5 MOE | 29 | 44 | 33 |
| ISIS 560574 | 5-10-5 MOE | 24 | 54 | 44 |
| ISIS 560847 | 5-10-5 MOE | 25 | 45 | 69 |
| ISIS 560992 | Deoxy, MOE and cEt | 32 | 128 | 112 |
| ISIS 561010 | Deoxy, MOE and cEt | 22 | 51 | 113 |
| ISIS 561011 | Deoxy, MOE and cEt | 28 | 43 | 114 |
| ISIS 561022 | Deoxy, MOE and cEt | 51 | 85 | 115 |
| ISIS 561025 | Deoxy, MOE and cEt | 22 | 48 | 116 |
| ISIS 563580 | 5-10-5 MOE | 28 | 109 | 77 |
| ISIS 567115 | 5-10-5 MOE | 21 | 42 | 88 |
| ISIS 567233 | 5-10-5 MOE | 22 | 73 | 90 |

Study 6

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN®. As shown in the Table below, treatment with several of the ISIS antisense oligonucleotides resulted in significant reduction of ANGPTL3 mRNA in comparison to the PBS control.

TABLE 181

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 68 | 233 |
| 561026 | Deoxy, MOE and cEt | 94 | 117 |
| 561079 | Deoxy, MOE and cEt | 51 | 160 |
| 561084 | Deoxy, MOE and cEt | 56 | 161 |
| 561123 | Deoxy, MOE and cEt | 47 | 163 |
| 561208 | Deoxy, MOE and cEt | 42 | 118 |
| 561241 | Deoxy, MOE and cEt | 13 | 164 |
| 561400 | Deoxy, MOE and cEt | 31 | 173 |
| 561418 | Deoxy, MOE and cEt | 32 | 169 |

TABLE 181-continued

Percent inhibition of ANGPTL3 mRNA in transgenic mouse liver relative to the PBS control

| ISIS No | Chemistry | % | SEQ ID NO |
|---------|-----------|---|-----------|
| 561436 | Deoxy, MOE and cEt | 67 | 170 |
| 561443 | Deoxy, MOE and cEt | 12 | 171 |
| 561458 | Deoxy, MOE and cEt | 57 | 124 |

Protein Analysis

Human ANGPTL3 Protein Levels were Quantified Using a Commercially Available ELISA Kit (Catalog #DANL30 by R&D Systems, Minneapolis, Minn.) with transgenic plasma samples diluted 1:20,000 using the manufacturer described protocol. The results are presented in the Table below. The results indicate that treatment with several of the ISIS oligonucleotides resulted in reduced ANGPTL3 protein levels.

TABLE 182

Percent inhibition of plasma protein levels in the transgenic mouse

| ISIS No | Chemistry | % | SEQ ID NO |
|---------|-----------|---|-----------|
| 233710 | 5-10-5 MOE | 82 | 233 |
| 561026 | Deoxy, MOE and cEt | 92 | 117 |
| 561079 | Deoxy, MOE and cEt | 80 | 160 |
| 561084 | Deoxy, MOE and cEt | 89 | 161 |
| 561123 | Deoxy, MOE and cEt | 62 | 163 |
| 561208 | Deoxy, MOE and cEt | 0 | 118 |
| 561241 | Deoxy, MOE and cEt | 36 | 164 |
| 561400 | Deoxy, MOE and cEt | 60 | 173 |
| 561418 | Deoxy, MOE and cEt | 42 | 169 |
| 561436 | Deoxy, MOE and cEt | 46 | 170 |
| 561443 | Deoxy, MOE and cEt | 27 | 171 |
| 561458 | Deoxy, MOE and cEt | 71 | 124 |

Plasma Chemistry Markers

To evaluate the effect of ISIS oligonucleotides on day 10, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 183

Plasma transaminase levels (IU/L) in transgenic mice on day 10

| | Chemistry | ALT | AST | SEQ ID NO |
|---|-----------|-----|-----|-----------|
| PBS | — | 41 | 64 | |
| ISIS 233710 | 5-10-5 MOE | 25 | 74 | 233 |
| ISIS 561026 | Deoxy, MOE and cEt | 30 | 67 | 117 |
| ISIS 561079 | Deoxy, MOE and cEt | 42 | 62 | 160 |
| ISIS 561084 | Deoxy, MOE and cEt | 70 | 101 | 161 |
| ISIS 561123 | Deoxy, MOE and cEt | 24 | 41 | 163 |
| ISIS 561208 | Deoxy, MOE and cEt | 203 | 168 | 118 |
| ISIS 561241 | Deoxy, MOE and cEt | 26 | 47 | 164 |
| ISIS 561400 | Deoxy, MOE and cEt | 27 | 83 | 173 |
| ISIS 561418 | Deoxy, MOE and cEt | 58 | 164 | 169 |
| ISIS 561436 | Deoxy, MOE and cEt | 24 | 42 | 170 |
| ISIS 561443 | Deoxy, MOE and cEt | 27 | 91 | 171 |
| ISIS 561458 | Deoxy, MOE and cEt | 30 | 144 | 124 |

Study 7

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 184

Percent inhibition of ANGPTL3 mRNA in transgenic mouse liver relative to the PBS control

| ISIS No | Chemistry | % | SEQ ID NO |
|---------|-----------|---|-----------|
| 233710 | 5-10-5 MOE | 80 | 233 |
| 561462 | Deoxy, MOE and cEt | 84 | 126 |
| 561463 | Deoxy, MOE and cEt | 84 | 127 |
| 561486 | Deoxy, MOE and cEt | 74 | 130 |
| 561487 | Deoxy, MOE and cEt | 82 | 131 |
| 561504 | Deoxy, MOE and cEt | 51 | 133 |
| 561528 | Deoxy, MOE and cEt | 87 | 174 |
| 561565 | Deoxy, MOE and cEt | 94 | 175 |
| 561566 | Deoxy, MOE and cEt | 76 | 176 |
| 561571 | Deoxy, MOE and cEt | 51 | 178 |
| 561621 | Deoxy, MOE and cEt | 93 | 134 |
| 561646 | Deoxy, MOE and cEt | 39 | 140 |
| 561649 | Deoxy, MOE and cEt | 93 | 141 |
| 561650 | Deoxy, MOE and cEt | 82 | 142 |
| 561689 | Deoxy, MOE and cEt | 51 | 180 |
| 561722 | Deoxy, MOE and cEt | 88 | 183 |
| 561723 | Deoxy, MOE and cEt | 85 | 184 |
| 561770 | Deoxy, MOE and cEt | 70 | 143 |
| 562024 | Deoxy, MOE and cEt | 82 | 189 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with some of the ISIS oligonucleotides resulted in reduced ANGPTL3 levels. In this case, '0' value implies that treatment with the ISIS oligonucleotide did not inhibit expression; in some instances, increased levels of expression may have been recorded.

TABLE 185

Percent inhibition of plasma protein levels in the transgenic mouse

| ISIS No | Chemistry | % | SEQ ID NO |
|---|---|---|---|
| 233710 | 5-10-5 MOE | 60 | 233 |
| 561462 | Deoxy, MOE and cEt | 62 | 126 |
| 561463 | Deoxy, MOE and cEt | 59 | 127 |
| 561486 | Deoxy, MOE and cEt | 0 | 130 |
| 561487 | Deoxy, MOE and cEt | 0 | 131 |
| 561504 | Deoxy, MOE and cEt | 0 | 133 |
| 561528 | Deoxy, MOE and cEt | 0 | 174 |
| 561565 | Deoxy, MOE and cEt | 71 | 175 |
| 561566 | Deoxy, MOE and cEt | 0 | 176 |
| 561571 | Deoxy, MOE and cEt | 0 | 178 |
| 561621 | Deoxy, MOE and cEt | 72 | 134 |
| 561646 | Deoxy, MOE and cEt | 0 | 140 |
| 561649 | Deoxy, MOE and cEt | 63 | 141 |
| 561650 | Deoxy, MOE and cEt | 0 | 142 |
| 561689 | Deoxy, MOE and cEt | 0 | 180 |
| 561722 | Deoxy, MOE and cEt | 0 | 183 |
| 561723 | Deoxy, MOE and cEt | 0 | 184 |
| 561770 | Deoxy, MOE and cEt | 0 | 143 |
| 562024 | Deoxy, MOE and cEt | 0 | 189 |

Plasma Chemistry Markers

To evaluate the effect of ISIS oligonucleotides on day 9, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 186

Plasma transaminase levels (IU/L) in transgenic mice on day 9

|  | Chemistry | ALT | AST | SEQ ID NO |
|---|---|---|---|---|
| PBS | — | 35 | 72 |  |
| ISIS 233710 | 5-10-5 MOE | 23 | 39 | 233 |
| ISIS 561462 | Deoxy, MOE and cEt | 26 | 56 | 126 |
| ISIS 561463 | Deoxy, MOE and cEt | 34 | 61 | 127 |
| ISIS 561486 | Deoxy, MOE and cEt | 23 | 61 | 130 |
| ISIS 561487 | Deoxy, MOE and cEt | 21 | 64 | 131 |
| ISIS 561504 | Deoxy, MOE and cEt | 26 | 66 | 133 |
| ISIS 561528 | Deoxy, MOE and cEt | 26 | 86 | 174 |
| ISIS 561565 | Deoxy, MOE and cEt | 24 | 43 | 175 |
| ISIS 561566 | Deoxy, MOE and cEt | 23 | 62 | 176 |
| ISIS 561571 | Deoxy, MOE and cEt | 26 | 68 | 178 |
| ISIS 561621 | Deoxy, MOE and cEt | 26 | 96 | 134 |
| ISIS 561646 | Deoxy, MOE and cEt | 24 | 77 | 140 |
| ISIS 561649 | Deoxy, MOE and cEt | 22 | 94 | 141 |
| ISIS 561650 | Deoxy, MOE and cEt | 34 | 121 | 142 |
| ISIS 561689 | Deoxy, MOE and cEt | 24 | 73 | 180 |
| ISIS 561722 | Deoxy, MOE and cEt | 34 | 89 | 183 |
| ISIS 561723 | Deoxy, MOE and cEt | 24 | 65 | 184 |
| ISIS 561770 | Deoxy, MOE and cEt | 22 | 69 | 143 |
| ISIS 562024 | Deoxy, MOE and cEt | 32 | 162 | 189 |

Study 8

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

TABLE 187

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 99 | 233 |
| 562078 | Deoxy, MOE and cEt | 73 | 147 |
| 562086 | Deoxy, MOE and cEt | 85 | 148 |
| 562103 | Deoxy, MOE and cEt | 58 | 149 |
| 562110 | Deoxy, MOE and cEt | 94 | 150 |
| 562155 | Deoxy, MOE and cEt | 85 | 192 |
| 562181 | Deoxy, MOE and cEt | 79 | 195 |
| 562433 | Deoxy, MOE and cEt | 59 | 155 |
| 562436 | Deoxy, MOE and cEt | 99 | 156 |
| 586669 | Deoxy, MOE and cEt | 95 | 210 |
| 586676 | Deoxy, MOE and cEt | 80 | 211 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with the ISIS oligonucleotides resulted in reduced ANGPTL3 levels.

TABLE 188

Percent inhibition of plasma protein levels in the transgenic mouse

| ISIS No | Chemistry | % | SEQ ID NO |
|---|---|---|---|
| 233710 | 5-10-5 MOE | 69 | 233 |
| 562078 | Deoxy, MOE and cEt | 44 | 147 |
| 562086 | Deoxy, MOE and cEt | 91 | 148 |
| 562103 | Deoxy, MOE and cEt | 26 | 149 |
| 562110 | Deoxy, MOE and cEt | 68 | 150 |
| 562155 | Deoxy, MOE and cEt | 75 | 192 |
| 562181 | Deoxy, MOE and cEt | 86 | 195 |
| 562433 | Deoxy, MOE and cEt | 80 | 155 |
| 562436 | Deoxy, MOE and cEt | 98 | 156 |
| 586669 | Deoxy, MOE and cEt | 98 | 210 |
| 586676 | Deoxy, MOE and cEt | 95 | 211 |

Plasma Chemistry Markers

To evaluate the effect of ISIS oligonucleotides on day 8, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 189

Plasma transaminase levels (IU/L) in transgenic mice on day 8

|  | Chemistry | ALT | AST | SEQ ID NO |
|---|---|---|---|---|
| PBS | — | 44 | 248 |  |
| ISIS 233710 | 5-10-5 MOE | 27 | 52 | 233 |
| ISIS 562078 | Deoxy, MOE and cEt | 41 | 130 | 147 |
| ISIS 562086 | Deoxy, MOE and cEt | 30 | 62 | 148 |
| ISIS 562103 | Deoxy, MOE and cEt | 35 | 99 | 149 |
| ISIS 562110 | Deoxy, MOE and cEt | 30 | 161 | 150 |
| ISIS 562155 | Deoxy, MOE and cEt | 68 | 622 | 192 |
| ISIS 562181 | Deoxy, MOE and cEt | 37 | 168 | 195 |
| ISIS 562433 | Deoxy, MOE and cEt | 33 | 209 | 155 |
| ISIS 562436 | Deoxy, MOE and cEt | 30 | 93 | 156 |
| ISIS 586669 | Deoxy, MOE and cEt | 27 | 141 | 210 |
| ISIS 586676 | Deoxy, MOE and cEt | 22 | 60 | 211 |

Study 9

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of deoxy, MOE, and cEt oligonucleotides at a dose of 25 mg/kg once per week for 2 weeks. ISIS 233710, a 5-10-5 MOE gapmer, was also included as a benchmark. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022. Results are presented as percent change of mRNA, relative to PBS control, normalized with RIBOGREEN®. As shown in the Table below, treatment with some of the ISIS antisense oligonucleotides resulted in significant reduction of ANGPTL3 mRNA in comparison to the PBS control. In this case, '0' value implies that treatment with the ISIS oligonucleotide did not inhibit expression; in some instances, increased levels of expression may have been recorded.

TABLE 190

Percent inhibition of ANGPTL3 mRNA in transgenic mouse liver relative to the PBS control

| ISIS No | Chemistry | % | SEQ ID NO |
|---|---|---|---|
| 233710 | 5-10-5 MOE | 84 | 233 |
| 586690 | Deoxy, MOE and cEt | 45 | 213 |
| 586692 | Deoxy, MOE and cEt | 45 | 220 |
| 586700 | Deoxy, MOE and cEt | 46 | 221 |
| 586707 | Deoxy, MOE and cEt | 88 | 218 |
| 586708 | Deoxy, MOE and cEt | 73 | 222 |
| 586718 | Deoxy, MOE and cEt | 20 | 219 |
| 586744 | Deoxy, MOE and cEt | 0 | 223 |
| 586745 | Deoxy, MOE and cEt | 0 | 224 |
| 586755 | Deoxy, MOE and cEt | 75 | 226 |
| 586761 | Deoxy, MOE and cEt | 66 | 227 |
| 586787 | Deoxy, MOE and cEt | 47 | 228 |
| 586796 | Deoxy, MOE and cEt | 88 | 229 |
| 586797 | Deoxy, MOE and cEt | 81 | 230 |
| 586802 | Deoxy, MOE and cEt | 33 | 231 |
| 586804 | Deoxy, MOE and cEt | 60 | 232 |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. The results indicate that treatment with some of the ISIS oligonucleotides resulted in reduced ANGPTL3 levels. In this case, '0' value implies that treatment with the ISIS oligonucleotide did not inhibit expression; in some instances, increased levels of expression may have been recorded.

TABLE 191

Percent inhibition of plasma protein levels in the transgenic mouse

| ISIS No | Chemistry | % | SEQ ID NO |
|---|---|---|---|
| 233710 | 5-10-5 MOE | 80 | 233 |
| 586690 | Deoxy, MOE and cEt | 21 | 213 |
| 586692 | Deoxy, MOE and cEt | 46 | 220 |
| 586700 | Deoxy, MOE and cEt | 0 | 221 |
| 586707 | Deoxy, MOE and cEt | 84 | 218 |
| 586708 | Deoxy, MOE and cEt | 32 | 222 |
| 586718 | Deoxy, MOE and cEt | 0 | 219 |
| 586744 | Deoxy, MOE and cEt | 0 | 223 |
| 586745 | Deoxy, MOE and cEt | 0 | 224 |
| 586755 | Deoxy, MOE and cEt | 0 | 226 |
| 586761 | Deoxy, MOE and cEt | 0 | 227 |
| 586787 | Deoxy, MOE and cEt | 0 | 228 |
| 586796 | Deoxy, MOE and cEt | 40 | 229 |
| 586797 | Deoxy, MOE and cEt | 50 | 230 |
| 586802 | Deoxy, MOE and cEt | 0 | 231 |
| 586804 | Deoxy, MOE and cEt | 0 | 232 |

Plasma Chemistry Markers

To evaluate the effect of ISIS oligonucleotides on day 9, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 192

Plasma transaminase levels (IU/L) in transgenic mice on day 9

| | Chemistry | ALT | AST | SEQ ID NO |
|---|---|---|---|---|
| PBS | — | 28 | 73 | |
| ISIS 233710 | 5-10-5 MOE | 22 | 86 | 233 |
| ISIS 586690 | Deoxy, MOE and cEt | 42 | 120 | 213 |
| ISIS 586692 | Deoxy, MOE and cEt | 22 | 45 | 220 |
| ISIS 586700 | Deoxy, MOE and cEt | 24 | 84 | 221 |
| ISIS 586707 | Deoxy, MOE and cEt | 26 | 44 | 218 |
| ISIS 586708 | Deoxy, MOE and cEt | 22 | 48 | 222 |
| ISIS 586718 | Deoxy, MOE and cEt | 22 | 39 | 219 |
| ISIS 586744 | Deoxy, MOE and cEt | 26 | 83 | 223 |
| ISIS 586745 | Deoxy, MOE and cEt | 25 | 56 | 224 |
| ISIS 586746 | Deoxy, MOE and cEt | 77 | 77 | 225 |
| ISIS 586755 | Deoxy, MOE and cEt | 28 | 148 | 226 |
| ISIS 586761 | Deoxy, MOE and cEt | 36 | 126 | 227 |
| ISIS 586787 | Deoxy, MOE and cEt | 23 | 88 | 228 |
| ISIS 586796 | Deoxy, MOE and cEt | 32 | 148 | 229 |
| ISIS 586797 | Deoxy, MOE and cEt | 29 | 151 | 230 |
| ISIS 586802 | Deoxy, MOE and cEt | 35 | 200 | 231 |
| ISIS 586804 | Deoxy, MOE and cEt | 24 | 87 | 232 |

Study 10

Male and female Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

Groups of mice received intraperitoneal injections of 5-10-5 MOE gapmers or deoxy, MOE and cEt oligonucleotides at a dose of 5 mg/kg, 12.5 mg/kg, or 25 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver for real-time PCR analysis of measurement of mRNA expression of ANGPTL3 with hANGPTL3_LTS01022, and also with RTS3492_MGB. Results are presented as percent change of mRNA, relative to PBS control, normalized with RIBOGREEN®. As shown in the Table below, treatment with some of the ISIS antisense oligonucleotides resulted in reduction of ANGPTL3 mRNA in comparison to the PBS control.

TABLE 193

Percent inhibition of ANGPTL3 mRNA in transgenic mouse liver relative to the PBS control

| ISIS No | Chemistry | Dose (mg/kg) | RTS3492_MGB | hANGPTL3_LTS01022 | SEQ ID NO |
|---|---|---|---|---|---|
| 233710 | 5-10-5 MOE | 25 | 0 | 8 | 233 |
| | | 12.5 | 24 | 22 | |
| | | 5 | 12 | 22 | |
| 544199 | 5-10-5 MOE | 25 | 63 | 59 | 20 |
| | | 12.5 | 43 | 43 | |
| | | 5 | 17 | 24 | |
| 559277 | Deoxy, MOE and cEt | 25 | 37 | 46 | 110 |
| | | 12.5 | 0 | 0 | |
| | | 5 | 0 | 0 | |
| 560400 | 5-10-5 MOE | 25 | 45 | 48 | 35 |
| | | 12.5 | 36 | 50 | |
| | | 5 | 0 | 0 | |
| 561010 | Deoxy, MOE and cEt | 25 | 5 | 37 | 113 |
| | | 12.5 | 0 | 6 | |
| | | 5 | 0 | 0 | |
| 563580 | 5-10-5 MOE | 25 | 56 | 59 | 77 |
| | | 12.5 | 43 | 44 | |
| | | 5 | 5 | 9 | |
| 567320 | 5-10-5 MOE | 25 | 47 | 50 | 93 |
| | | 12.5 | 0 | 0 | |
| | | 5 | 0 | 0 | |
| 567321 | 5-10-5 MOE | 25 | 46 | 32 | 94 |
| | | 12.5 | 0 | 0 | |
| | | 5 | 0 | 0 | |

Plasma Chemistry Markers

To evaluate the effect of ISIS oligonucleotides on day 8, plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 194

Plasma transaminase levels (IU/L) in transgenic mice on day 8

| | Chemistry | Dose (mg/kg) | ALT | AST | SEQ ID NO |
|---|---|---|---|---|---|
| PBS | — | — | 22 | 82 | |
| ISIS 233710 | 5-10-5 MOE | 25 | 21 | 41 | 233 |
| | | 12.5 | 23 | 66 | |
| | | 5 | 22 | 118 | |
| ISIS 544199 | 5-10-5 MOE | 25 | 25 | 47 | 20 |
| | | 12.5 | 20 | 40 | |
| | | 5 | 27 | 43 | |
| ISIS 559277 | Deoxy, MOE and cEt | 25 | 21 | 34 | 110 |
| | | 12.5 | 21 | 37 | |
| | | 5 | 22 | 39 | |
| ISIS 560400 | 5-10-5 MOE | 25 | 21 | 37 | 35 |
| | | 12.5 | 20 | 44 | |
| | | 5 | 24 | 35 | |
| ISIS 561010 | Deoxy, MOE and cEt | 25 | 22 | 48 | 113 |
| | | 12.5 | 33 | 64 | |
| | | 5 | 24 | 41 | |
| ISIS 563580 | 5-10-5 MOE | 25 | 21 | 36 | 77 |
| | | 12.5 | 29 | 81 | |
| | | 5 | 21 | 59 | |
| ISIS 567320 | 5-10-5 MOE | 25 | 22 | 47 | 93 |
| | | 12.5 | 29 | 58 | |
| | | 5 | 21 | 70 | |
| ISIS 567321 | 5-10-5 MOE | 25 | 20 | 50 | 94 |
| | | 12.5 | 24 | 102 | |
| | | 5 | 19 | 53 | |

Example 127

Tolerability of Antisense Oligonucleotides Targeting Human ANGPTL3 in CD1 Mice

CD1® mice (Charles River, Mass.) are a multipurpose mice model, frequently utilized for safety and efficacy testing. The mice were treated with ISIS antisense oligonucleotides selected from studies described above and evaluated for changes in the levels of various plasma chemistry markers.

Study 1

Male CD1 mice (one animal per treatment group) were injected intraperitoneally with a single dose of 200 mg/kg of deoxy, MOE, and cEt oligonucleotide. One male CD1 mouse was injected subcutaneously with a single dose of PBS. Mice were euthanized 48 hours after the last dose, and organs and plasma were harvested for further analysis.

Plasma Chemistry Markers

To evaluate the effect of ISIS oligonucleotides on day 4 plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 195

Plasma transaminase levels in CD1 mice plasma on day 4

|  | ALT (IU/L) | AST (IU/L) | SEQ ID NO |
|---|---|---|---|
| ISIS 559277 | 29 | 43 | 110 |
| ISIS 560990 | 19 | 43 | 111 |
| ISIS 560992 | 21 | 36 | 112 |
| ISIS 561010 | 31 | 40 | 113 |
| ISIS 561011 | 27 | 32 | 114 |
| ISIS 561022 | 35 | 48 | 115 |
| ISIS 561025 | 17 | 28 | 116 |
| ISIS 561026 | 31 | 43 | 117 |
| ISIS 561208 | 32 | 47 | 118 |
| ISIS 561320 | 25 | 37 | 119 |
| ISIS 561343 | 41 | 90 | 120 |
| ISIS 561345 | 30 | 45 | 121 |
| ISIS 561347 | 31 | 41 | 122 |
| ISIS 561458 | 18 | 38 | 124 |
| ISIS 561460 | 42 | 59 | 125 |
| ISIS 561463 | 21 | 33 | 127 |
| ISIS 561486 | 17 | 39 | 130 |
| ISIS 561487 | 18 | 39 | 131 |
| ISIS 561504 | 24 | 41 | 133 |
| ISIS 561621 | 31 | 56 | 134 |

Body Weights

Body weights were measured one day after the single dose of ISIS oligonucleotide, and are presented in the Table below. ISIS oligonucleotides that caused any changes in organ weights outside the expected range for antisense oligonucleotides were excluded from further studies.

TABLE 196

Body weights (g) of CD1 mice after antisense oligonucleotide treatment

|  | Body weight | SEQ ID NO |
|---|---|---|
| ISIS 559277 | 27 | 110 |
| ISIS 560990 | 28 | 111 |
| ISIS 560992 | 29 | 112 |
| ISIS 561010 | 30 | 113 |
| ISIS 561011 | 27 | 114 |
| ISIS 561022 | 24 | 115 |
| ISIS 561025 | 28 | 116 |
| ISIS 561026 | 27 | 117 |
| ISIS 561208 | 29 | 118 |
| ISIS 561320 | 27 | 119 |
| ISIS 561343 | 24 | 120 |
| ISIS 561345 | 25 | 121 |
| ISIS 561347 | 28 | 122 |
| ISIS 561458 | 25 | 124 |
| ISIS 561460 | 26 | 125 |
| ISIS 561463 | 26 | 127 |
| ISIS 561486 | 26 | 130 |
| ISIS 561487 | 27 | 131 |
| ISIS 561504 | 26 | 133 |
| ISIS 561621 | 27 | 134 |

Study 2

Male CD1 mice (one animal per treatment group) were injected intraperitoneally with a single dose of 200 mg/kg of deoxy, MOE and cEt oligonucleotides. One male CD1 mouse was injected subcutaneously with a single dose of PBS. Mice were euthanized 48 hours after the last dose, and organs and plasma were harvested for further analysis.

Plasma Chemistry Markers

To evaluate the effect of ISIS oligonucleotides on day 5 plasma levels of transaminases (ALT and AST) were measured using an automated clinical chemistry analyzer (Hitachi Olympus AU400e, Melville, N.Y.). The results are presented in the Table below. ISIS oligonucleotides that caused changes in the levels of any of these liver function markers outside the expected range for antisense oligonucleotides were excluded in further studies.

TABLE 197

Plasma transaminase levels in CD1 mice plasma on day 5

|  | ALT (IU/L) | AST (IU/L) | SEQ ID NO |
|---|---|---|---|
| ISIS 561622 | 29 | 64 | 136 |
| ISIS 561628 | 17 | 24 | 137 |
| ISIS 561646 | 16 | 34 | 140 |
| ISIS 561650 | 32 | 51 | 142 |
| ISIS 561079 | 19 | 32 | 160 |
| ISIS 561084 | 24 | 56 | 161 |
| ISIS 561241 | 60 | 70 | 164 |
| ISIS 561462 | 22 | 54 | 126 |
| ISIS 561649 | 56 | 53 | 141 |
| ISIS 561770 | 23 | 39 | 143 |
| ISIS 561781 | 20 | 41 | 144 |
| ISIS 561918 | 31 | 112 | 146 |
| ISIS 562078 | 15 | 33 | 147 |
| ISIS 562086 | 19 | 32 | 148 |
| ISIS 562110 | 20 | 41 | 150 |
| ISIS 562415 | 13 | 30 | 154 |
| ISIS 562433 | 19 | 35 | 155 |
| ISIS 562436 | 21 | 37 | 156 |
| ISIS 562442 | 19 | 34 | 158 |

Body Weights

Body weights were measured on day 5 after the single dose of ISIS oligonucleotide, and are presented in the Table below. ISIS oligonucleotides that caused any changes in organ weights outside the expected range for antisense oligonucleotides were excluded from further studies.

TABLE 198

Body weights (g) of CD1 mice after antisense oligonucleotide treatment

|  | Body weights | SEQ ID NO |
|---|---|---|
| ISIS 561622 | 27 | 136 |
| ISIS 561628 | 28 | 137 |
| ISIS 561646 | 29 | 140 |
| ISIS 561650 | 30 | 142 |
| ISIS 561079 | 27 | 160 |
| ISIS 561084 | 24 | 161 |
| ISIS 561241 | 28 | 164 |
| ISIS 561462 | 27 | 126 |
| ISIS 561649 | 29 | 141 |
| ISIS 561770 | 27 | 143 |
| ISIS 561781 | 24 | 144 |
| ISIS 561918 | 25 | 146 |
| ISIS 562078 | 28 | 147 |
| ISIS 562086 | 25 | 148 |
| ISIS 562110 | 26 | 150 |
| ISIS 562415 | 26 | 154 |
| ISIS 562433 | 26 | 155 |
| ISIS 562436 | 27 | 156 |
| ISIS 562442 | 26 | 158 |

Study 3

Male CD1 mice (four animals per treatment group) were injected intraperitoneally with 100 mg/kg of 5-10-5 MOE gapmers given once a week for 6 weeks. One group of 4 male CD1 mice was injected intraperitoneally with PBS given once a week for 6 weeks. Mice were euthanized 48 hours after the last dose, and organs and plasma were harvested for further analysis.

Plasma Chemistry Markers

To evaluate the effect of ISIS oligonucleotides, plasma levels of various liver and kidney function markers were measured on day 45 using an automated clinical chemistry analyzer (Hitachi Olympus AU400e, Melville, N.Y.). The results are presented in the Table below. ISIS oligonucleotides that caused changes in the levels of any of these markers outside the expected range for antisense oligonucleotides were excluded in further studies.

TABLE 199

Plasma chemistry marker levels in CD1 mice plasma on day 45

|  | ALT (IU/L) | AST (IU/L) | Albumin (g/dL) | BUN (mg/dL) | Creatinine (mg/dL) | Bilurubin (mg/dL) | SEQ ID NO |
|---|---|---|---|---|---|---|---|
| PBS | 30 | 55 | 2.7 | 26 | 0.15 | 0.17 |  |
| ISIS 544145 | 1146 | 1081 | 2.5 | 29 | 0.14 | 0.24 | 16 |
| ISIS 544199 | 244 | 213 | 2.6 | 25 | 0.13 | 0.15 | 20 |
| ISIS 560400 | 211 | 244 | 2.5 | 28 | 0.14 | 0.14 | 35 |
| ISIS 560401 | 212 | 269 | 2.4 | 31 | 0.14 | 0.12 | 36 |
| ISIS 560469 | 165 | 160 | 2.4 | 24 | 0.11 | 0.14 | 38 |
| ISIS 567320 | 141 | 146 | 2.7 | 25 | 0.14 | 0.15 | 93 |
| ISIS 567321 | 106 | 122 | 2.5 | 24 | 0.11 | 0.13 | 94 |

Body Weights

Body weights were measured on day 43, and are presented in the Table below. Kidney, liver and spleen weights were measured at the end of the study on day 45. ISIS oligonucleotides that caused any changes in organ weights outside the expected range for antisense oligonucleotides were excluded from further studies.

TABLE 200

Weights (g) of CD1 mice after antisense oligonucleotide treatment

|  | Body | Kidney | Liver | Spleen | SEQ ID NO |
|---|---|---|---|---|---|
| PBS | 39 | 0.6 | 2.1 | 0.1 |  |
| ISIS 544145 | 30 | 0.5 | 1.9 | 0.1 | 16 |
| ISIS 544199 | 42 | 0.6 | 2.9 | 0.3 | 20 |
| ISIS 560400 | 40 | 0.6 | 2.8 | 0.3 | 35 |
| ISIS 560401 | 38 | 0.6 | 2.7 | 0.2 | 36 |
| ISIS 560469 | 40 | 0.6 | 2.7 | 0.2 | 38 |
| ISIS 567320 | 39 | 0.6 | 2.3 | 0.3 | 93 |
| ISIS 567321 | 42 | 0.6 | 2.6 | 0.3 | 94 |

Study 4

Male CD1 mice (four animals per treatment group) were injected intraperitoneally with 50 mg/kg or 100 mg/kg of 5-10-5 MOE gapmers or deoxy, MOE and cEt oligonucleotides given once a week for 6 weeks. One group of 4 male CD1 mice was injected intraperitoneally with PBS given once a week for 6 weeks. Mice were euthanized 48 hours after the last dose, and organs and plasma were harvested for further analysis.

Plasma Chemistry Markers

To evaluate the effect of ISIS oligonucleotides, plasma levels of various liver and kidney function markers were measured on day 46 using an automated clinical chemistry analyzer (Hitachi Olympus AU400e, Melville, N.Y.). The results are presented in the Table below. ISIS oligonucleotides that caused changes in the levels of any of these markers outside the expected range for antisense oligonucleotides were excluded in further studies.

TABLE 201

Plasma chemistry marker levels in CD1 mice plasma on day 45

| | Chemistry | Dose (mg/kg) | ALT (IU/L) | AST (IU/L) | Albumin (g/dL) | BUN (mg/dL) | Creatinine (mg/dL) | Bilirubin (mg/dL) | SEQ ID NO |
|---|---|---|---|---|---|---|---|---|---|
| PBS | | — | 28 | 46 | 2.7 | 28 | 0.13 | 0.13 | |
| ISIS 544156 | 5-10-5 MOE | 100 | 80 | 145 | 2.2 | 26 | 0.12 | 0.10 | 17 |
| ISIS 560574 | 5-10-5 MOE | 100 | 182 | 184 | 2.5 | 25 | 0.14 | 0.15 | 44 |
| ISIS 561010 | Deoxy, MOE and cEt | 50 | 32 | 53 | 2.4 | 31 | 0.15 | 0.12 | 113 |
| ISIS 561011 | Deoxy, MOE and cEt | 50 | 93 | 152 | 1.8 | 27 | 0.15 | 0.08 | 114 |
| ISIS 560580 | 5-10-5 MOE | 100 | 50 | 76 | 2.5 | 25 | 0.12 | 0.13 | 237 |
| ISIS 567115 | 5-10-5 MOE | 100 | 202 | 304 | 2.5 | 19 | 0.14 | 0.12 | 88 |
| ISIS 567233 | 5-10-5 MOE | 100 | 123 | 145 | 2.5 | 24 | 0.12 | 0.12 | 90 |

Body Weights

Body weights were measured on day 44, and are presented in the Table below. Kidney, liver and spleen weights were measured at the end of the study on day 46. ISIS oligonucleotides that caused any changes in organ weights outside the expected range for antisense oligonucleotides were excluded from further studies.

measured on day 43 using an automated clinical chemistry analyzer (Hitachi Olympus AU400e, Melville, N.Y.). The results are presented in the Table below. ISIS oligonucleotides that caused changes in the levels of any of these markers outside the expected range for antisense oligonucleotides were excluded in further studies.

TABLE 202

Weights (g) of CD1 mice after antisense oligonucleotide treatment

| | Chemistry | Dose (mg/kg) | Body | Kidney | Liver | Spleen | SEQ ID NO |
|---|---|---|---|---|---|---|---|
| PBS | | — | 38 | 0.6 | 2.1 | 0.2 | |
| ISIS 544156 | 5-10-5 MOE | 100 | 36 | 0.5 | 2.2 | 0.2 | 17 |
| ISIS 560574 | 5-10-5 MOE | 100 | 40 | 0.6 | 2.6 | 0.4 | 44 |
| ISIS 561010 | Deoxy, MOE and cEt | 50 | 39 | 0.5 | 2.2 | 0.2 | 113 |
| ISIS 561011 | Deoxy, MOE and cEt | 50 | 39 | 0.6 | 2.9 | 0.3 | 114 |
| ISIS 560580 | 5-10-5 MOE | 100 | 39 | 0.5 | 2.4 | 0.2 | 237 |
| ISIS 567115 | 5-10-5 MOE | 100 | 36 | 0.5 | 2.2 | 0.2 | 88 |
| ISIS 567233 | 5-10-5 MOE | 100 | 39 | 0.6 | 2.2 | 0.3 | 90 |

Study 5

Male CD1 mice (four animals per treatment group) were injected intraperitoneally with 50 mg/kg of deoxy, MOE and cEt oligonucleotides given once a week for 6 weeks. One group of 4 male CD1 mice was injected intraperitoneally with PBS given once a week for 6 weeks. Mice were euthanized 48 hours after the last dose, and organs and plasma were harvested for further analysis.

Plasma Chemistry Markers

To evaluate the effect of ISIS oligonucleotides, plasma levels of various liver and kidney function markers were

TABLE 203

Plasma chemistry marker levels in CD1 mice plasma on day 43

| | ALT (IU/L) | AST (IU/L) | Albumin (g/dL) | BUN (mg/dL) | Creatinine (mg/dL) | Bilirubin (mg/dL) | SEQ ID NO |
|---|---|---|---|---|---|---|---|
| PBS | 35 | 166 | 2.6 | 29 | 0.12 | 0.32 | |
| ISIS 559277 | 45 | 77 | 2.5 | 29 | 0.13 | 0.16 | 110 |
| ISIS 561022 | 826 | 802 | 2.9 | 29 | 0.13 | 0.99 | 115 |
| ISIS 561025 | 146 | 183 | 2.3 | 28 | 0.14 | 0.13 | 116 |
| ISIS 561026 | 93 | 154 | 2.6 | 26 | 0.11 | 0.16 | 117 |
| ISIS 561079 | 1943 | 1511 | 2.9 | 28 | 0.15 | 0.94 | 160 |
| ISIS 561084 | 153 | 227 | 2.6 | 27 | 0.12 | 0.16 | 161 |
| ISIS 561123 | 49 | 90 | 2.5 | 31 | 0.13 | 0.13 | 163 |
| ISIS 561436 | 29 | 57 | 2.6 | 25 | 0.12 | 0.12 | 170 |

Body Weights

Body weights were measured on day 41, and are presented in the Table below. Kidney, liver and spleen weights were measured at the end of the study on day 43. ISIS oligonucleotides that caused any changes in organ weights outside the expected range for antisense oligonucleotides were excluded from further studies.

TABLE 204

Weights (g) of CD1 mice after antisense oligonucleotide treatment

|  | Body | Kidney | Liver | Spleen | SEQ ID NO |
|---|---|---|---|---|---|
| PBS | 37 | 0.5 | 2.0 | 0.1 |  |
| ISIS 559277 | 38 | 0.6 | 2.5 | 0.3 | 110 |
| ISIS 561022 | 31 | 0.4 | 3.2 | 0.1 | 115 |
| ISIS 561025 | 37 | 0.5 | 2.6 | 0.2 | 116 |
| ISIS 561026 | 39 | 0.6 | 2.1 | 0.2 | 117 |
| ISIS 561079 | 42 | 0.6 | 4.0 | 0.2 | 160 |
| ISIS 561084 | 37 | 0.6 | 2.4 | 0.2 | 161 |
| ISIS 561123 | 36 | 0.6 | 2.2 | 0.2 | 163 |
| ISIS 561436 | 41 | 0.6 | 2.4 | 0.2 | 170 |

Example 128

Measurement of Viscosity of ISIS Antisense Oligonucleotides Targeting Human ANGPTL3

The viscosity of select antisense oligonucleotides from the studies described above was measured with the aim of screening out antisense oligonucleotides which have a viscosity of more than 40 centipoise (cP). Oligonucleotides having a viscosity greater than 40 cP would have less than optimal viscosity.

ISIS oligonucleotides (32-35 mg) were weighed into a glass vial, 120 μL of water was added and the antisense oligonucleotide was dissolved into solution by heating the vial at 50° C. Part (75 μL) of the pre-heated sample was pipetted to a micro-viscometer (Cambridge). The temperature of the micro-viscometer was set to 25° C. and the viscosity of the sample was measured. Another part (20 μL) of the pre-heated sample was pipetted into 10 mL of water for UV reading at 260 nM at 85° C. (Cary UV instrument). The results are presented in the Table below, where the concentration of each antisense oligonucleotide was 350 mg/ml, and indicate that most of the antisense oligonucleotides solutions are optimal in their viscosity under the criterion stated above.

TABLE 205

Viscosity of ISIS antisense oligonucleotides targeting human ANGPTL3

| ISIS No. | Viscosity (cP) | SEQ ID NO |
|---|---|---|
| 233710 | 14.65 | 233 |
| 337478 | 13.34 | 235 |
| 544145 | 11.97 | 16 |
| 544162 | 8.50 | 18 |
| 544199 | 11.70 | 20 |
| 560306 | 5.67 | 34 |
| 560400 | 9.26 | 35 |
| 560401 | 18.11 | 36 |
| 560402 | 90.67 | 37 |
| 560469 | 12.04 | 38 |
| 560735 | 7.49 | 49 |
| 567320 | 9.05 | 93 |
| 567321 | 9.62 | 94 |
| 567233 | 6.72 | 90 |
| 563580 | 16.83 | 77 |
| 561010 | 26.32 | 113 |
| 561011 | 43.15 | 114 |

Example 129

Tolerability of Antisense Oligonucleotides Targeting Human ANGPTL3 in Sprague-Dawley Rats Sprague-Dawley rats are a multipurpose model used for safety and efficacy evaluations. The rats were treated with ISIS antisense oligonucleotides from the studies described in the Examples above and evaluated for changes in the levels of various plasma chemistry markers.

Study 1

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with PBS or with 100 mg/kg of 5-10-5 MOE gapmers. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 45 and the results are presented in the Table below expressed in IU/L. Plasma levels of bilirubin were also measured using the same clinical chemistry analyzer and the results are also presented in the Table below expressed in mg/dL. ISIS oligonucleotides that caused changes in the levels of any markers of liver function outside the expected range for antisense oligonucleotides were excluded in further studies.

TABLE 206

Liver function markers in Sprague-Dawley rats

|  | ALT (IU/L) | AST (IU/L) | Bilirubin (mg/dL) | SEQ ID NO |
|---|---|---|---|---|
| PBS | 25 | 65 | 0.11 |  |
| ISIS 544145 | 225 | 407 | 0.30 | 16 |
| ISIS 544199 | 56 | 102 | 0.11 | 20 |
| ISIS 560400 | 55 | 175 | 0.12 | 35 |
| ISIS 560401 | 89 | 206 | 0.13 | 36 |
| ISIS 560469 | 227 | 290 | 0.15 | 38 |
| ISIS 567320 | 55 | 172 | 0.11 | 93 |
| ISIS 567321 | 39 | 109 | 0.10 | 94 |

Kidney Function

To evaluate the effect of ISIS oligonucleotides on kidney function, plasma levels of blood urea nitrogen (BUN) and creatinine were measured using an automated clinical chemistry analyzer (Hitachi Olympus AU400e, Melville, N.Y.). Results are presented in the Table below, expressed in mg/dL. ISIS oligonucleotides that caused changes in the levels of any of the kidney function markers outside the expected range for antisense oligonucleotides were excluded in further studies. Total urine protein and urine creatinine levels were measured, and the ratio of total urine protein to creatinine was evaluated. The results are presented in the Table below.

TABLE 207

Kidney function plasma markers (mg/dL) in Sprague-Dawley rats

|  | BUN | Creatinine | SEQ ID NO |
|---|---|---|---|
| PBS | 16 | 0.27 |  |
| ISIS 544145 | 53 | 0.26 | 16 |
| ISIS 544199 | 24 | 0.34 | 20 |
| ISIS 560400 | 28 | 0.31 | 35 |
| ISIS 560401 | 29 | 0.28 | 36 |
| ISIS 560469 | 23 | 0.32 | 38 |
| ISIS 567320 | 26 | 0.35 | 93 |
| ISIS 567321 | 24 | 0.37 | 94 |

TABLE 208

Kidney function urine markers in Sprague-Dawley rats

|  | Creatinine (mg/dL) | Total protein (mg/dL) | Protein: Creatinine ratio | SEQ ID NO |
|---|---|---|---|---|
| PBS | 59 | 90 | 1.5 |  |
| ISIS 544145 | 27 | 2131 | 84.8 | 16 |
| ISIS 544199 | 24 | 199 | 8.6 | 20 |
| ISIS 560400 | 32 | 176 | 5.4 | 35 |
| ISIS 560401 | 29 | 521 | 17.3 | 36 |
| ISIS 560469 | 43 | 351 | 8.2 | 38 |
| ISIS 567320 | 34 | 177 | 5.2 | 93 |
| ISIS 567321 | 54 | 269 | 5.3 | 94 |

Organ Weights

Body weights were measured on day 42 and presented in the Table below. Liver, spleen and kidney weights were measured at the end of the study on day 45, and are presented in the Table below. ISIS oligonucleotides that caused any changes in organ weights outside the expected range for antisense oligonucleotides were excluded from further studies.

TABLE 209

Body and organ weights (g) of Sprague Dawley rats

|  | Body | Kidney | Liver | Spleen | SEQ ID NO |
|---|---|---|---|---|---|
| PBS | 441 | 3.3 | 11.8 | 0.8 |  |
| ISIS 544145 | 240 | 3.0 | 11.2 | 1.7 | 16 |
| ISIS 544199 | 307 | 2.6 | 10.3 | 2.0 | 20 |
| ISIS 560400 | 294 | 2.8 | 12.3 | 2.0 | 35 |
| ISIS 560401 | 281 | 3.4 | 11.6 | 2.3 | 36 |
| ISIS 560469 | 316 | 3.0 | 11.8 | 2.0 | 38 |
| ISIS 567320 | 312 | 3.1 | 12.4 | 2.5 | 93 |
| ISIS 567321 | 332 | 3.3 | 11.6 | 2.3 | 94 |

Study 2

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with PBS or with 50 mg/kg or 100 mg/kg of 5-10-5 MOE gapmers or deoxy, MOE and cEt oligonucleotides. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 44 and the results are presented in the Table below expressed in IU/L. Plasma levels of bilirubin were also measured using the same clinical chemistry analyzer and the results are also presented in the Table below expressed in mg/dL. ISIS oligonucleotides that caused changes in the levels of any markers of liver function outside the expected range for antisense oligonucleotides were excluded in further studies.

TABLE 210

Liver function markers in Sprague-Dawley rats

|  | Chemistry | Dose (mg/kg) | ALT (IU/L) | AST (IU/L) | Bilirubin (mg/dL) | SEQ ID NO |
|---|---|---|---|---|---|---|
| PBS | — | — | 22 | 63 | 0.09 |  |
| ISIS 544156 | 5-10-5 MOE | 100 | 153 | 221 | 0.19 | 17 |
| ISIS 560574 | 5-10-5 MOE | 100 | 62 | 128 | 0.24 | 44 |
| ISIS 561010 | Deoxy, MOE and cEt | 50 | 32 | 99 | 0.12 | 113 |
| ISIS 561011 | Deoxy, MOE and cEt | 50 | 56 | 100 | 0.11 | 114 |
| ISIS 563580 | 5-10-5 MOE | 100 | 74 | 89 | 0.09 | 77 |
| ISIS 567233 | 5-10-5 MOE | 100 | 41 | 136 | 0.08 | 90 |

Kidney Function

To evaluate the effect of ISIS oligonucleotides on kidney function, plasma levels of blood urea nitrogen (BUN) and creatinine were measured on day 44 using an automated clinical chemistry analyzer (Hitachi Olympus AU400e, Melville, N.Y.). Results are presented in the Table below, expressed in mg/dL. ISIS oligonucleotides that caused changes in the levels of any of the kidney function markers outside the expected range for antisense oligonucleotides were excluded in further studies. Total urine protein and urine creatinine levels were measured, and the ratio of total urine protein to creatinine was evaluated. The results are presented in the Table below.

TABLE 211

Kidney function plasma markers (mg/dL) in Sprague-Dawley rats

|  | Chemistry | Dose (mg/kg) | BUN | Creatinine | SEQ ID NO |
|---|---|---|---|---|---|
| PBS | — | — | 18 | 0.31 |  |
| ISIS 544156 | 5-10-5 MOE | 100 | 27 | 0.27 | 17 |
| ISIS 560574 | 5-10-5 MOE | 100 | 32 | 0.24 | 44 |
| ISIS 561010 | Deoxy, MOE and cEt | 50 | 24 | 0.31 | 113 |
| ISIS 561011 | Deoxy, MOE and cEt | 50 | 33 | 0.32 | 114 |
| ISIS 563580 | 5-10-5 MOE | 100 | 25 | 0.20 | 77 |
| ISIS 567233 | 5-10-5 MOE | 100 | 37 | 0.23 | 90 |

TABLE 212

Kidney function urine markers in Sprague-Dawley rats

|  | Chemistry | Dose (mg/kg) | Creatinine (mg/dL) | Total protein (mg/dL) | Protein: Creatinine ratio | SEQ ID NO |
|---|---|---|---|---|---|---|
| PBS | — | — | 55 | 66 | 1.2 |  |
| ISIS 544156 | 5-10-5 MOE | 100 | 26 | 166 | 6.2 | 17 |
| ISIS 560574 | 5-10-5 MOE | 100 | 39 | 276 | 6.8 | 44 |
| ISIS 561010 | Deoxy, MOE and cEt | 50 | 54 | 299 | 5.6 | 113 |
| ISIS 561011 | Deoxy, MOE and cEt | 50 | 41 | 525 | 11.7 | 114 |
| ISIS 563580 | 5-10-5 MOE | 100 | 44 | 338 | 8.1 | 77 |
| ISIS 567233 | 5-10-5 MOE | 100 | 46 | 307 | 6.4 | 90 |

Organ Weights

Body weights were measured on day 42 and presented in the Table below. Liver, spleen and kidney weights were measured at the end of the study on day 44, and are presented in the Table below. ISIS oligonucleotides that caused any changes in organ weights outside the expected range for antisense oligonucleotides were excluded from further studies.

TABLE 213

Body and organ weights (g) of Sprague Dawley rats

|  | Chemistry | Dose (mg/kg) | Body | Kidney | Liver | Spleen | SEQ ID NO |
|---|---|---|---|---|---|---|---|
| PBS | — | — | 433 | 3.1 | 10.8 | 0.6 |  |
| ISIS 544156 | 5-10-5 MOE | 100 | 291 | 2.4 | 10.6 | 1.6 | 17 |
| ISIS 560574 | 5-10-5 MOE | 100 | 315 | 3.1 | 10.7 | 2.1 | 44 |
| ISIS 561010 | Deoxy, MOE and cEt | 50 | 386 | 3.0 | 11.9 | 2.1 | 113 |
| ISIS 561011 | Deoxy, MOE and cEt | 50 | 324 | 4.1 | 12.5 | 2.4 | 114 |
| ISIS 563580 | 5-10-5 MOE | 100 | 358 | 3.0 | 12.8 | 1.5 | 77 |
| ISIS 567233 | 5-10-5 MOE | 100 | 286 | 2.9 | 13.0 | 2.9 | 90 |

Study 3

Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with PBS or with 50 mg/kg of deoxy, MOE and cEt oligonucleotides. Forty eight hours after the last dose, rats were euthanized and organs and plasma were harvested for further analysis.

Liver Function

To evaluate the effect of ISIS oligonucleotides on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 44 and the results are presented in the Table below expressed in IU/L. Plasma levels of bilirubin were also measured using the same clinical chemistry analyzer and the results are also presented in the Table below expressed in mg/dL. ISIS oligonucleotides that caused changes in the levels of any markers of liver function outside the expected range for antisense oligonucleotides were excluded in further studies.

TABLE 214

Liver function markers in Sprague-Dawley rats

|  | ALT (IU/L) | AST (IU/L) | Bilirubin (mg/dL) | SEQ ID NO |
|---|---|---|---|---|
| PBS | 27 | 87 | 0.08 |  |
| ISIS 559277 | 36 | 108 | 0.10 | 110 |

TABLE 214-continued

Liver function markers in Sprague-Dawley rats

|  | ALT (IU/L) | AST (IU/L) | Bilirubin (mg/dL) | SEQ ID NO |
|---|---|---|---|---|
| ISIS 561025 | 150 | 260 | 0.15 | 116 |
| ISIS 561026 | 53 | 105 | 0.08 | 117 |
| ISIS 561079 | 87 | 196 | 0.09 | 160 |
| ISIS 561084 | 62 | 177 | 0.11 | 161 |
| ISIS 561123 | 39 | 94 | 0.07 | 163 |
| ISIS 561436 | 64 | 225 | 0.13 | 170 |

Kidney Function

To evaluate the effect of ISIS oligonucleotides on kidney function, plasma levels of blood urea nitrogen (BUN) and creatinine were measured on day 44 using an automated clinical chemistry analyzer (Hitachi Olympus AU400e, Melville, N.Y.). Results are presented in the Table below, expressed in mg/dL. ISIS oligonucleotides that caused changes in the levels of any of the kidney function markers outside the expected range for antisense oligonucleotides were excluded in further studies. Total urine protein and urine creatinine levels were measured, and the ratio of total urine protein to creatinine was evaluated. The results are presented in the Table below.

TABLE 215

Kidney function plasma markers (mg/dL) in Sprague-Dawley rats

|  | BUN | Creatinine | SEQ ID NO |
|---|---|---|---|
| PBS | 12 | 0.26 |  |
| ISIS 559277 | 16 | 0.30 | 110 |
| ISIS 561025 | 24 | 0.34 | 116 |
| ISIS 561026 | 61 | 0.38 | 117 |
| ISIS 561079 | 87 | 0.67 | 160 |
| ISIS 561084 | 24 | 0.35 | 161 |
| ISIS 561123 | 16 | 0.31 | 163 |
| ISIS 561436 | 39 | 0.37 | 170 |

TABLE 216

Kidney function urine markers in Sprague-Dawley rats

|  | Creatinine (mg/dL) | Total protein (mg/dL) | Protein: Creatinine ratio | SEQ ID NO |
|---|---|---|---|---|
| PBS | 42 | 77 | 1.9 |  |
| ISIS 559277 | 35 | 253 | 7.2 | 110 |
| ISIS 561025 | 47 | 583 | 14.3 | 116 |
| ISIS 561026 | 22 | 1993 | 111.4 | 117 |
| ISIS 561079 | 17 | 1313 | 75.5 | 160 |
| ISIS 561084 | 73 | 571 | 7.9 | 161 |
| ISIS 561123 | 33 | 925 | 29.5 | 163 |
| ISIS 561436 | 25 | 789 | 36.6 | 170 |

Organ Weights

Body weights were measured on day 42 and presented in the table below. Liver, spleen and kidney weights were measured at the end of the study on day 44, and are presented in the Table below. ISIS oligonucleotides that caused any changes in organ weights outside the expected range for antisense oligonucleotides were excluded from further studies.

TABLE 217

Body and organ weights (g) of Sprague Dawley rats

|  | Body | Kidney | Liver | Spleen | SEQ ID NO |
|---|---|---|---|---|---|
| PBS | 419 | 3.2 | 10.7 | 0.7 |  |
| ISIS 559277 | 365 | 3.5 | 11.2 | 1.6 | 110 |
| ISIS 561025 | 335 | 3.2 | 12.8 | 2.7 | 116 |
| ISIS 561026 | 334 | 4.9 | 13.9 | 2.3 | 117 |
| ISIS 561079 | 302 | 3.9 | 9.9 | 0.9 | 160 |
| ISIS 561084 | 317 | 3.5 | 12.2 | 1.9 | 161 |
| ISIS 561123 | 367 | 3.3 | 13.5 | 1.5 | 163 |
| ISIS 561436 | 272 | 3.1 | 9.8 | 2.9 | 170 |

Example 130

Effect of ISIS Antisense Oligonucleotides Targeting Human ANGPTL3 in Cynomolgus Monkeys Cynomolgus monkeys were treated with ISIS antisense oligonucleotides selected from studies described in the Examples above. Antisense oligonucleotide efficacy and tolerability, as well as their pharmacokinetic profile in the liver and kidney, were evaluated.

At the time this study was undertaken, the cynomolgus monkey genomic sequence was not available in the National Center for Biotechnology Information (NCBI) database; therefore, cross-reactivity with the cynomolgus monkey gene sequence could not be confirmed. Instead, the sequences of the ISIS antisense oligonucleotides used in the cynomolgus monkeys was compared to a rhesus monkey sequence for homology. It is expected that ISIS oligonucleotides with homology to the rhesus monkey sequence are fully cross-reactive with the cynomolgus monkey sequence as well. The human antisense oligonucleotides tested are cross-reactive with the rhesus monkey genomic sequence (GENBANK Accession No. NW_001108682.1 truncated from nucleotides 3049001 to 3062000, designated herein as SEQ ID NO: 3). The greater the complementarity between the human oligonucleotide and the rhesus monkey sequence, the more likely the human oligonucleotide can cross-react with the rhesus monkey sequence. The start and stop sites of each oligonucleotide to SEQ ID NO: 3 is presented in the Table below. "Start site" indicates the 5'-most nucleotide to which the gapmer is targeted in the rhesus monkey gene sequence. 'Mismatches' indicates the number of nucleobases in the human oligonucleotide that are mismatched with the rhesus genomic sequence.

TABLE 218

Antisense oligonucleotides complementary to the rhesus ANGPTL3 genomic sequence (SEQ ID NO: 3)

| ISIS No | Target Start Site | Mismatches | Chemistry | SEQ ID NO |
|---|---|---|---|---|
| 563580 | 9315 | 2 | 5-10-5 MOE | 77 |
| 560400 | 10052 | 1 | 5-10-5 MOE | 35 |
| 567320 | 10232 | 1 | 5-10-5 MOE | 93 |
| 567321 | 10234 | 1 | 5-10-5 MOE | 94 |
| 544199 | 10653 | 0 | 5-10-5 MOE | 20 |
| 567233 | 6834 | 2 | 5-10-5 MOE | 90 |
| 561011 | 3220 | 1 | Deoxy, MOE and (S)-cEt | 114 |
| 559277 | 3265 | 0 | Deoxy, MOE and (S)-cEt | 110 |

Treatment

Prior to the study, the monkeys were kept in quarantine for at least a 30 day period, during which the animals were observed daily for general health. The monkeys were 2-4 years old and weighed between 2 and 4 kg. Nine groups of 5 randomly assigned male cynomolgus monkeys each were injected subcutaneously with ISIS oligonucleotide or PBS at four sites on the back in a clockwise rotation (i.e. left, top, right, and bottom), one site per dose. The monkeys were given loading doses of PBS or 40 mg/kg of ISIS oligonucleotide every two days for the first week (days 1, 3, 5, and 7) and were subsequently dosed once a week for 12 weeks (days 14, 21, 28, 35, 42, 49, 56, 63, 70, 77, and 84) with PBS or 40 mg/kg of ISIS oligonucleotide.

During the study period, the monkeys were observed twice daily for signs of illness or distress. Any animal experiencing more than momentary or slight pain or distress due to the treatment, injury or illness was treated by the veterinary staff with approved analgesics or agents to relieve the pain after consultation with the Study Director. Any animal in poor health or in a possible moribund condition was identified for further monitoring and possible euthanasia. For example, one animal in the ISIS 567321 treatment group was found moribund on day 45 and was terminated. Scheduled euthanasia of the animals was conducted on day 86 (approximately 48 hours after the final dose) by exsanguination after ketamine/xylazine-induced anesthesia and administration of sodium pentobarbital. The protocols described in the Example were approved by the Institutional Animal Care and Use Committee (IACUC).

Hepatic Target Reduction
RNA Analysis

On day 86, RNA was extracted from liver for real-time PCR analysis of measurement of mRNA expression of ANGPTL3. Results are presented as percent change of mRNA, relative to PBS control, normalized with RIBOGREEN®. As shown in the Table below, treatment with ISIS antisense oligonucleotides resulted in significant reduction of ANGPTL3 mRNA in comparison to the PBS control.

Analysis of ANGPTL3 mRNA levels revealed that ISIS 544199 and ISIS 559277, which are both fully cross-reactive with the rhesus sequence, significantly reduced expression levels. Other ISIS oligonucleotides, which targeted the monkey sequence with mismatches, were also able to reduce ANGPTL3 mRNA levels.

TABLE 219

Percent inhibition of ANGPTL3 mRNA in the cynomolgus monkey liver relative to the PBS control

| ISIS No | % | SEQ ID NO |
|---|---|---|
| 563580 | 62 | 77 |
| 560400 | 59 | 35 |
| 567320 | 67 | 93 |
| 567321 | 34 | 94 |
| 544199 | 88 | 20 |
| 561011 | 47 | 114 |
| 559277 | 85 | 110 |

Protein Analysis

Approximately 1 mL of blood was collected from all available animals at day 85 and placed in tubes containing the potassium salt of EDTA. The blood samples were placed in ice and centrifuged (3000 rpm for 10 min at 4° C.) to obtain plasma.

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. Analysis of plasman ANGPTL3 revealed that ISIS 563580, 544199 and ISIS 559277 reduced protein levels in a sustained manner Other ISIS oligonucleotides were also able to reduce ANGPTL3 levels.

TABLE 220

Plasma protein levels (ng/mL) in the cynomolgus monkey

| | Day 1 | Day 3 | Day 16 | Day 30 | Day 44 | Day 58 | Day 72 | Day 86 | SEQ ID NO |
|---|---|---|---|---|---|---|---|---|---|
| PBS | 142 | 113 | 122 | 75 | 147 | 170 | 130 | 158 | |
| ISIS 563580 | 113 | 99 | 102 | 46 | 109 | 93 | 82 | 81 | 77 |
| ISIS 560400 | 92 | 107 | 145 | 63 | 170 | 182 | 157 | 178 | 35 |
| ISIS 567320 | 87 | 72 | 94 | 56 | 176 | 181 | 134 | 166 | 93 |
| ISIS 567321 | 80 | 84 | 98 | 62 | 156 | 116 | 122 | 112 | 94 |
| ISIS 544199 | 114 | 84 | 50 | 34 | 66 | 56 | 81 | 71 | 20 |
| ISIS 567233 | 115 | 111 | 174 | 134 | 162 | 125 | 122 | 109 | 90 |
| ISIS 561011 | 89 | 92 | 111 | 106 | 104 | 100 | 140 | 129 | 114 |
| ISIS 559277 | 86 | 62 | 63 | 54 | 77 | 64 | 68 | 70 | 110 |

Tolerability Studies
Body Weight Measurements

To evaluate the effect of ISIS oligonucleotides on the overall health of the animals, body and weights were measured and are presented in the Table below. The results indicate that effect of treatment with antisense oligonucleotides on body weights was within the expected range for antisense oligonucleotides. Specifically, treatment with ISIS 563580 was well tolerated in terms of the body weights of the monkeys.

TABLE 221

Final body weights (g) in cynomolgus monkey

| | Day 1 | Day 14 | Day 28 | Day 35 | Day 56 | Day 70 | Day 84 | SEQ ID NO |
|---|---|---|---|---|---|---|---|---|
| PBS | 2713 | 2709 | 2721 | 2712 | 2761 | 2754 | 2779 | |
| ISIS 563580 | 2678 | 2669 | 2724 | 2699 | 2797 | 2798 | 2817 | 77 |
| ISIS 560400 | 2713 | 2738 | 2808 | 2767 | 2867 | 2920 | 2976 | 35 |
| ISIS 567320 | 2682 | 2707 | 2741 | 2731 | 2804 | 2830 | 2853 | 93 |
| ISIS 567321 | 2672 | 2745 | 2849 | 2845 | 2995 | 2965 | 3002 | 94 |
| ISIS 544199 | 2760 | 2813 | 2851 | 2897 | 2905 | 2888 | 2871 | 20 |
| ISIS 567233 | 2657 | 2668 | 2650 | 2677 | 2907 | 2963 | 2903 | 90 |
| ISIS 561011 | 2753 | 2797 | 2801 | 2811 | 2921 | 2967 | 2941 | 114 |
| ISIS 559277 | 2681 | 2688 | 2701 | 2755 | 2826 | 2831 | 2965 | 110 |

Liver Function

To evaluate the effect of ISIS oligonucleotides on hepatic function, blood samples were collected from all the study groups. The blood samples were collected from the cephalic, saphenous, or femoral veins, 48 hours post-dosing. The monkeys were fasted overnight prior to blood collection. Blood was collected in tubes without anticoagulant for serum separation. The tubes were kept at room temperature for a minimum of 90 minutes and then centrifuged (approximately 3,000 rpm for 10 min) to obtain serum. Levels of various liver function markers were measured using a Toshiba 200FR NEO chemistry analyzer (Toshiba Co., Japan). Plasma levels of ALT and AST were measured and the results are presented in the Table below, expressed in IU/L. Bilirubin, a liver function marker, was similarly measured and is presented in the Table below expressed in mg/dL. The results indicate that most of the antisense oligonucleotides had no effect on liver function outside the expected range for antisense oligonucleotides. Specifically, treatment with ISIS 563580 was well tolerated in terms of the liver function in monkeys.

TABLE 222

ALT levels (IU/L) in cynomolgus monkey plasma

|  | Day 1 | Day 30 | Day 58 | Day 86 | SEQ ID NO |
|---|---|---|---|---|---|
| PBS | 47 | 35 | 32 | 46 |  |
| ISIS 563580 | 56 | 55 | 55 | 83 | 77 |
| ISIS 560400 | 50 | 35 | 47 | 68 | 35 |
| ISIS 567320 | 72 | 44 | 51 | 106 | 93 |
| ISIS 567321 | 53 | 39 | 44 | 75 | 94 |
| ISIS 544199 | 58 | 49 | 51 | 51 | 20 |
| ISIS 567233 | 42 | 38 | 47 | 64 | 90 |
| ISIS 561011 | 48 | 35 | 34 | 43 | 114 |
| ISIS 559277 | 49 | 45 | 53 | 60 | 110 |

TABLE 223

AST levels (IU/L) in cynomolgus monkey plasma

|  | Day 1 | Day 30 | Day 58 | Day 86 | SEQ ID NO |
|---|---|---|---|---|---|
| PBS | 76 | 42 | 39 | 60 |  |
| ISIS 563580 | 75 | 56 | 42 | 81 | 77 |
| ISIS 560400 | 85 | 63 | 59 | 99 | 35 |
| ISIS 567320 | 104 | 64 | 55 | 153 | 93 |
| ISIS 567321 | 83 | 47 | 45 | 66 | 94 |
| ISIS 544199 | 68 | 68 | 70 | 91 | 20 |
| ISIS 567233 | 46 | 80 | 66 | 86 | 90 |
| ISIS 561011 | 48 | 39 | 41 | 51 | 114 |
| ISIS 559277 | 50 | 56 | 55 | 77 | 110 |

TABLE 224

Bilirubin levels (mg/dL) in cynomolgus monkey plasma

|  | Day 1 | Day 30 | Day 58 | Day 86 | SEQ ID NO |
|---|---|---|---|---|---|
| PBS | 0.31 | 0.24 | 0.20 | 0.19 |  |
| ISIS 563580 | 0.34 | 0.23 | 0.17 | 0.18 | 77 |
| ISIS 560400 | 0.29 | 0.19 | 0.14 | 0.13 | 35 |
| ISIS 567320 | 0.38 | 0.24 | 0.16 | 0.19 | 93 |
| ISIS 567321 | 0.35 | 0.20 | 0.16 | 0.17 | 94 |
| ISIS 544199 | 0.23 | 0.16 | 0.17 | 0.15 | 20 |
| ISIS 567233 | 0.26 | 0.17 | 0.15 | 0.12 | 90 |
| ISIS 561011 | 0.20 | 0.13 | 0.16 | 0.13 | 114 |
| ISIS 559277 | 0.22 | 0.15 | 0.16 | 0.15 | 110 |

Kidney Function

To evaluate the effect of ISIS oligonucleotides on kidney function, blood samples were collected from all the study groups. The blood samples were collected from the cephalic, saphenous, or femoral veins, 48 hours post-dosing. The monkeys were fasted overnight prior to blood collection. Blood was collected in tubes without anticoagulant for serum separation. The tubes were kept at room temperature for a minimum of 90 minutes and then centrifuged (approximately 3,000 rpm for 10 min) to obtain serum. Levels of BUN and creatinine were measured using a Toshiba 200FR NEO chemistry analyzer (Toshiba Co., Japan). Results are presented in the Table below, expressed in mg/dL.

The plasma chemistry data indicate that most of the ISIS oligonucleotides did not have any effect on the kidney function outside the expected range for antisense oligonucleotides. Specifically, treatment with ISIS 563580 was well tolerated in terms of the kidney function of the monkeys.

TABLE 225

Plasma BUN levels (mg/dL) in cynomolgus monkeys

|  | Day 1 | Day 30 | Day 58 | Day 86 | SEQ ID NO |
|---|---|---|---|---|---|
| PBS | 28 | 28 | 27 | 29 |  |
| ISIS 563580 | 27 | 27 | 25 | 27 | 77 |
| ISIS 560400 | 25 | 24 | 21 | 27 | 35 |
| ISIS 567320 | 27 | 28 | 26 | 32 | 93 |
| ISIS 567321 | 25 | 24 | 23 | 24 | 94 |
| ISIS 544199 | 23 | 25 | 24 | 23 | 20 |
| ISIS 567233 | 23 | 32 | 30 | 29 | 90 |
| ISIS 561011 | 25 | 24 | 23 | 24 | 114 |
| ISIS 559277 | 26 | 28 | 24 | 26 | 110 |

TABLE 226

Plasma creatinine levels (mg/dL) in cynomolgus monkeys

|  | Day 1 | Day 30 | Day 58 | Day 86 | SEQ ID NO |
|---|---|---|---|---|---|
| PBS | 0.96 | 0.95 | 0.89 | 0.88 |  |
| ISIS 563580 | 0.97 | 1.04 | 0.88 | 0.85 | 77 |
| ISIS 560400 | 0.99 | 1.00 | 0.93 | 0.91 | 35 |
| ISIS 567320 | 0.95 | 0.94 | 0.89 | 0.87 | 93 |
| ISIS 567321 | 0.97 | 0.94 | 0.89 | 0.87 | 94 |
| ISIS 544199 | 0.86 | 0.87 | 0.88 | 0.87 | 20 |
| ISIS 567233 | 0.89 | 1.08 | 1.06 | 1.00 | 90 |
| ISIS 561011 | 0.93 | 0.93 | 0.91 | 0.90 | 114 |
| ISIS 559277 | 0.86 | 0.91 | 0.87 | 0.91 | 110 |

Hematology

To evaluate any effect of ISIS oligonucleotides in cynomolgus monkeys on hematologic parameters, blood samples of approximately 0.5 mL of blood was collected from each of the available study animals in tubes containing $K_2$-EDTA. Samples were analyzed for red blood cell (RBC) count, white blood cells (WBC) count, individual white blood cell counts, such as that of monocytes, neutrophils, lymphocytes, as well as for platelet count, hemoglobin content and hematocrit, using an ADVIA120 hematology analyzer (Bayer, USA). The data is presented in the Tables below.

The data indicate the oligonucleotides did not cause any changes in hematologic parameters outside the expected range for antisense oligonucleotides at this dose. Specifically, treatment with ISIS 563580 was well tolerated in terms of the hematologic parameters of the monkeys.

TABLE 227

Blood cell counts in cynomolgus monkeys

| | RBC (×10⁶/μL) | Platelets (×10³/μL) | WBC (×10³/μL) | Neutrophils (% WBC) | Lymphocytes (% total) | Monocytes (% total) | SEQ ID NO |
|---|---|---|---|---|---|---|---|
| PBS | 5.6 | 462 | 12.2 | 58 | 39 | 2 | |
| ISIS 563580 | 5.5 | 394 | 10.7 | 52 | 44 | 2 | 77 |
| ISIS 560400 | 5.7 | 269 | 10.2 | 44 | 50 | 3 | 35 |
| ISIS 567320 | 5.1 | 329 | 9.1 | 51 | 44 | 3 | 93 |
| ISIS 567321 | 5.3 | 363 | 8.9 | 60 | 36 | 2 | 94 |
| ISIS 544199 | 5.6 | 316 | 9.7 | 34 | 61 | 3 | 20 |
| ISIS 567233 | 5.0 | 298 | 12.1 | 40 | 53 | 4 | 90 |
| ISIS 561011 | 5.5 | 356 | 10.2 | 33 | 62 | 3 | 114 |
| ISIS 559277 | 5.1 | 343 | 8.3 | 45 | 49 | 3 | 110 |

TABLE 228

Hematologic parameters in cynomolgus monkeys

| | Hemoglobin (g/dL) | HCT (%) | SEQ ID NO |
|---|---|---|---|
| PBS | 13 | 43 | |
| ISIS 563580 | 12 | 40 | 77 |
| ISIS 560400 | 12 | 41 | 35 |
| ISIS 567320 | 11 | 38 | 93 |
| ISIS 567321 | 12 | 41 | 94 |
| ISIS 544199 | 13 | 44 | 20 |
| ISIS 567233 | 11 | 38 | 90 |
| ISIS 561011 | 13 | 42 | 114 |
| ISIS 559277 | 12 | 40 | 110 |

Effect on Pro-Inflammatory Molecules

To evaluate any inflammatory effect of ISIS oligonucleotides in cynomolgus monkeys, blood samples were taken for analysis of C-reactive protein and C3 levels on day 84 pre-dose. Approximately 1.5 mL of blood was collected from each animal and put into tubes without anticoagulant for serum separation. The tubes were kept at room temperature for a minimum of 90 min and then centrifuged at 3,000 rpm for 10 min at room temperature to obtain serum. C-reactive protein (CRP) and complement C3, which serve as markers of inflammation, were measured using a Toshiba 200FR NEO chemistry analyzer (Toshiba Co., Japan). The results indicate that treatment with ISIS 563580 was tolerable in monkeys.

TABLE 229

C-reactive protein levels (mg/L) in cynomolgus monkey plasma

| | Day 1 | Day 30 | Day 58 | Day 86 | SEQ ID NO |
|---|---|---|---|---|---|
| PBS | 3.1 | 5.5 | 2.7 | 4.1 | |
| ISIS 563580 | 2.4 | 2.4 | 4.5 | 3.9 | 77 |
| ISIS 560400 | 3.4 | 7.5 | 9.2 | 14.4 | 35 |
| ISIS 567320 | 2.5 | 1.7 | 2.5 | 4.3 | 93 |
| ISIS 567321 | 3.7 | 3.1 | 5.5 | 7.0 | 94 |
| ISIS 544199 | 1.2 | 1.5 | 8.8 | 8.1 | 20 |
| ISIS 567233 | 1.9 | 12.0 | 6.8 | 6.6 | 90 |
| ISIS 561011 | 1.7 | 1.2 | 2.1 | 3.7 | 114 |
| ISIS 559277 | 1.8 | 2.1 | 10.9 | 5.2 | 110 |

TABLE 230

C3 levels (mg/dL) in cynomolgus monkey plasma

| | Pre-dose | Day 84 | SEQ ID NO |
|---|---|---|---|
| PBS | 122 | 117 | |
| ISIS 563580 | 116 | 84 | 77 |
| ISIS 560400 | 120 | 105 | 35 |
| ISIS 567320 | 114 | 100 | 93 |
| ISIS 567321 | 106 | 93 | 94 |
| ISIS 544199 | 113 | 66 | 20 |
| ISIS 567233 | 113 | 63 | 90 |
| ISIS 561011 | 115 | 79 | 114 |
| ISIS 559277 | 119 | 87 | 110 |

Measurement of Oligonucleotide Concentration

The concentration of the full-length oligonucleotide was measured. The method used is a modification of previously published methods (Leeds et al., 1996; Geary et al., 1999) which consist of a phenol-chloroform (liquid-liquid) extraction followed by a solid phase extraction. An internal standard (ISIS 355868, a 27-mer 2'-O-methoxyethyl modified phosphorothioate oligonucleotide, GCGTTTGCTCTTCTTCT-TGCGTTTTTT, designated herein as SEQ ID NO: 13) was added prior to extraction. Tissue sample concentrations were calculated using calibration curves, with a lower limit of quantitation (LLOQ) of approximately 1.14 μg/g. The results are presented in the Table below, expressed as μg/g liver or kidney tissue. The ratio of full-length oligonucleotide concentrations in the kidney versus the liver was calculated. The ratio of full-length oligonucleotide concentrations in the kidney versus the liver after treatment with ISIS 563580 was found to be most optimal compared to other compounds assessed.

TABLE 231

Oligonucleotide full length concentration

| ISIS No | Kidney | Liver | Kidney/Liver ratio | SEQ ID NO |
|---|---|---|---|---|
| 563580 | 1822 | 1039 | 1.8 | 77 |
| 560400 | 3807 | 1375 | 2.8 | 35 |
| 567320 | 2547 | 569 | 4.5 | 93 |
| 567321 | 2113 | 463 | 4.6 | 94 |
| 544199 | 1547 | 561 | 2.8 | 20 |
| 561011 | 2027 | 477 | 4.3 | 114 |
| 559277 | 2201 | 508 | 4.3 | 110 |

Example 131

Comparison of Antisense Inhibition of Human ANGPTL3 in huANGPTL3 Transgenic Mice by ISIS Oligonucleotides Comprising a GalNAc Conjugate Group and ISIS Oligonucleotides that do not Comprise a GalNAc Conjugate Group Antisense oligonucleotides comprising GalNAc$_3$-7$_a$ were evaluated in comparison with their unconjugated counterparts for their ability to reduce human ANGPTL3 mRNA transcript in Tg mice. The gapmers, which target SEQ ID NO: 1, are described in the Table below and in Table 121. The symbols of the Backbone Chemistry column are as follows: 's' denotes thioate ester and 'o' denotes phosphate ester.

TABLE 232

ISIS oligonucleotides

| ISIS No | Sequence | Target Start Site | Conjugate | Backbone Chemistry | SEQ ID NO |
|---|---|---|---|---|---|
| 563580 | GGACATTGCCAGTAATCGCA | 1140 | None | sssssssssssssssssss | 77 |
| 703801 | GGACATTGCCAGTAATCGCA | 1140 | GalNAc$_3$-7a | sssssssssssssssssss | 77 |
| 703802 | GGACATTGCCAGTAATCGCA | 1140 | GalNAc$_3$-7a | soooossssssssssooss | 77 |

Female and male Tg mice were maintained on a 12-hour light/dark cycle. Animals were acclimated for at least 7 days in the research facility before initiation of the experiment. Antisense oligonucleotides (ASOs) were prepared in buffered saline (PBS) and sterilized by filtering through a 0.2 micron filter. Oligonucleotides were dissolved in 0.9% PBS for injection.

A group of 4 mice received subcutaneous injections of ISIS 563580 at doses of 5 mg/kg, 10 mg/kg, 15 mg/kg, or 30 mg/kg once per week for 2 weeks. Groups of 4 mice each received intraperitoneal injections of ISIS 703801 or ISIS 703802 at doses of 0.3 mg/kg, 1 mg/kg, 3 mg/kg, or 10 mg/kg once per week for 2 weeks. One group of mice received subcutaneous injections of PBS once weekly for 2 weeks. The PBS-injected group served as the control group to which the corresponding oligonucleotide-treated groups were compared.

RNA Analysis

At the end of the treatment period, RNA was extracted from liver tissue for real-time PCR analysis of measurement of mRNA expression of ANGPTL3 with human primer probe set hANGPTL3_LTS01022. Results are presented as percent change of mRNA, relative to PBS control, normalized with RIBOGREEN®. A zero value simply indicates that the antisense oligonucleotide did not inhibit expression at a measurable level.

The results demonstrate that the conjugated compounds are much more potent in reducing ANGPTL3 expression than their unconjugated counterpart as evident from the percent inhibition and ID$_{50}$ values. The conjugated oligonucleotide with mixed backbone chemistry (703802) was more potent in inhibiting expression than the conjugated oligonucleotide with full phosphorothioate backbone chemistry (703801).

TABLE 233

Percent inhibition of ANGPTL3 mRNA in transgenic mouse liver relative to the PBS control

| ISIS No | Dose (mg/kg) | % inhibition | ID$_{50}$ (mg/kg/wk) |
|---|---|---|---|
| 563580 | 30 | 79 | 6 |
| | 15 | 73 | |
| | 10 | 72 | |
| | 5 | 40 | |
| 703801 | 10 | 85 | 1 |
| | 3 | 89 | |
| | 1 | 54 | |
| | 0.3 | 32 | |

TABLE 233-continued

Percent inhibition of ANGPTL3 mRNA in transgenic mouse liver relative to the PBS control

| ISIS No | Dose (mg/kg) | % inhibition | ID$_{50}$ (mg/kg/wk) |
|---|---|---|---|
| 703802 | 10 | 89 | 0.3 |
| | 3 | 85 | |
| | 1 | 67 | |
| | 0.3 | 52 | |

Protein Analysis

Human ANGPTL3 protein levels were quantified using a commercially available ELISA kit (Catalog #DANL30 by R&D Systems, Minneapolis, Minn.) with transgenic plasma samples diluted 1:20,000 using the manufacturer described protocol. The results are presented in the Table below. A zero value simply indicates that the antisense oligonucleotide did not inhibit expression at a measurable level.

The results demonstrate that the conjugated compounds are more potent in reducing ANGPTL3 expression than their unconjugated counterpart as evident from the percent inhibition values. The conjugated oligonucleotide with mixed backbone chemistry (703802) was more potent in inhibiting expression than the conjugated oligonucleotide with full phosphorothioate backbone chemistry (703801).

TABLE 234

Percent inhibition of plasma protein levels in the transgenic mouse

| ISIS No | Dose (mg/kg) | % inhibition |
|---|---|---|
| 563580 | 30 | 77 |
| | 15 | 74 |
| | 10 | 75 |
| | 5 | 56 |
| 703801 | 10 | 82 |
| | 3 | 40 |

TABLE 234-continued

Percent inhibition of plasma protein levels in the transgenic mouse

| ISIS No | Dose (mg/kg) | % inhibition |
|---|---|---|
|  | 1 | 0 |
|  | 0.3 | 0 |
| 703802 | 10 | 81 |
|  | 3 | 81 |
|  | 1 | 64 |
|  | 0.3 | 66 |

Example 132

Tolerability of a GalNAc Conjugated Antisense Oligonucleotide Targeting Human ANGPTL3 in CD1 Mice Male CD1 mice (four animals per treatment group) were injected subcutaneously with various doses of ISIS 703802 as described in the Table below for 6 weeks (on days 1, 3, 5, 8, 14, 21, 28, 35 and 42). One group of 4 male CD1 mice was injected subcutaneously with PBS for 6 weeks. Mice were euthanized 48 hours after the last dose, and organs and plasma were harvested for further analysis.

Plasma Chemistry Markers

To evaluate the effect of ISIS 703802, plasma levels of various liver and kidney function markers were measured on day 44 using an automated clinical chemistry analyzer (Hitachi Olympus AU400e, Melville, N.Y.). The results are presented in the Table below. ISIS 703802 was shown to be a tolerable compound even at high doses.

TABLE 235

Plasma chemistry marker levels in CD1 mice plasma on day 44

|  | ALT (IU/L) | AST (IU/L) | Albumin (g/dL) | BUN (mg/dL) | Creatinine (mg/dL) | Bilirubin (mg/dL) |
|---|---|---|---|---|---|---|
| PBS | 34 | 49 | 2.6 | 27 | 0.15 | 0.13 |
| ISIS 703802 50 mg/kg/wk | 96 | 81 | 2.8 | 25 | 0.17 | 0.17 |
| ISIS 703802 20 mg/kg/wk | 54 | 56 | 2.7 | 27 | 0.16 | 0.17 |
| ISIS 703802 10 mg/kg/wk | 37 | 49 | 2.7 | 28 | 0.19 | 0.15 |
| ISIS 703802 5 mg/kg/wk | 36 | 46 | 2.7 | 26 | 0.16 | 0.16 |

Body Weights

Body, kidney, liver and spleen weights were measured at the end of the study on day 44. ISIS 703802 did not significantly change body and organ weights even when administered at high doses.

TABLE 236

Weights (g) of CD1 mice after antisense oligonucleotide treatment

|  | Body | Kidney | Liver | Spleen |
|---|---|---|---|---|
| PBS | 42 | 0.64 | 2.06 | 0.12 |
| ISIS 703802 50 mg/kg/wk | 39 | 0.53 | 2.42 | 0.10 |
| ISIS 703802 20 mg/kg/wk | 40 | 0.57 | 2.29 | 0.13 |
| ISIS 703802 10 mg/kg/wk | 43 | 0.66 | 2.36 | 0.13 |
| ISIS 703802 5 mg/kg/wk | 42 | 0.63 | 2.38 | 0.13 |

Example 133

Tolerability of a GalNAc Conjugated Antisense Oligonucleotide Targeting Human ANGPTL3 in Sprague-Dawley Rats Sprague-Dawley rats are a multipurpose model used for safety and efficacy evaluations. Male Sprague-Dawley rats were maintained on a 12-hour light/dark cycle and fed ad libitum with Purina normal rat chow, diet 5001. Groups of 4 Sprague-Dawley rats each were injected subcutaneously with various doses of ISIS 703802 as described in the Table below for 6 weeks (on days 1, 3, 5, 8, 14, 21, 28, 35, and 42). One group of 4 rats was injected subcutaneously with PBS for 6 weeks. Rats were euthanized 48 hours after the last dose, and organs and plasma were harvested for further analysis.

Liver and Kidney Function

To evaluate the effect of ISIS 703802 on hepatic function, plasma levels of transaminases were measured using an automated clinical chemistry analyzer (Hitachi Olympus AU400e, Melville, N.Y.). Plasma levels of ALT (alanine transaminase) and AST (aspartate transaminase) were measured on day 44 and the results are presented in the Table below expressed in IU/L.

To evaluate the effect of ISIS 703802 on renal function, plasma levels of albumin, blood urea nitrogen (BUN), creatitine and bilirubin were measured using the same clinical chemistry analyzer and the results are presented in the Table below expressed in g/dL or mg/dL.

To further evaluate the effect of ISIS 703802 on renal function, urine protein and urine creatinine levels were measured, and the ratio of total urine protein to creatinine was evaluated. The results are presented in the Table below.

ISIS 703802 was shown to be a tolerable compound even at high doses.

TABLE 237

Liver and kidney function markers in Sprague-Dawley rat plasma on day 44

|  | ALT (IU/L) | AST (IU/L) | Albumin (g/dL) | BUN (mg/dL) | Creatinine (mg/dL) | Bilirubin (mg/dL) |
|---|---|---|---|---|---|---|
| PBS | 28 | 72 | 3.2 | 15 | 0.25 | 0.07 |
| ISIS 703802 50 mg/kg/wk | 86 | 97 | 3.4 | 17 | 0.26 | 0.09 |
| ISIS 703802 20 mg/kg/wk | 62 | 91 | 3.3 | 18 | 0.29 | 0.09 |
| ISIS 703802 10 mg/kg/wk | 64 | 99 | 3.2 | 15 | 0.27 | 0.08 |
| ISIS 703802 5 mg/kg/wk | 48 | 88 | 3.3 | 15 | 0.26 | 0.07 |

TABLE 238

Kidney function urine markers (mg/dL) in Sprague-Dawley rat on day 44

|  | Creatinine (mg/dL) | MTP (mg/dL) | Protein: Creatinine ratio |
|---|---|---|---|
| PBS | 91 | 100 | 1.13 |
| ISIS 703802 50 mg/kg/wk | 82 | 172 | 2.04 |
| ISIS 703802 20 mg/kg/wk | 89 | 178 | 2.05 |
| ISIS 703802 10 mg/kg/wk | 85 | 103 | 1.26 |
| ISIS 703802 5 mg/kg/wk | 117 | 134 | 1.17 |

Organ Weights

Body, liver, spleen and kidney weights were measured at the end of the study on day 44 and are presented in the Table below. ISIS 703802 did not significantly change body, kidney and liver weights even when administered at high doses.

TABLE 239

| Body and organ weights (g) of Sprague Dawley rats | | | | |
|---|---|---|---|---|
| | Body | Kidney | Liver | Spleen |
| PBS | 471 | 3.6 | 13 | 0.67 |
| ISIS 703802 50 mg/kg/wk | 445 | 3.6 | 14 | 1.37 |

TABLE 239-continued

| Body and organ weights (g) of Sprague Dawley rats | | | | |
|---|---|---|---|---|
| | Body | Kidney | Liver | Spleen |
| ISIS 703802 20 mg/kg/wk | 435 | 3.3 | 14 | 0.97 |
| ISIS 703802 10 mg/kg/wk | 464 | 3.5 | 14 | 0.91 |
| ISIS 703802 5 mg/kg/wk | 468 | 3.0 | 15 | 0.75 |

SEQUENCE LISTING (4914 sequences)

SEQ ID NO: 1 - DNA, 2126 bp, Homo sapiens
ttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatt

SEQ ID NO: 2 - DNA, 14000 bp, Homo sapiens
caagactacgtgaccattacctctactctgtcagtgttatttgtgagaaattgcacaaattttgcaaaaagtgttagtatcctactacagtaggatataatatagaaggaaataatttcataaagcctgtctttggtactagtgctcagttactttcattaactaaaaaaggggctactcttcaaattcccttctctaaaaagaatgtactatatcaaaagggggtaaacactactacgtatacattctgcacttagaaatccctatatgttgattttatcattctcttattcaataaatattgtttctacaatgtgtaaggcattactgtactaaagcattataaggaatataagttaaaaacacatacaaatcttgccaatcaacagcttatagtgtaataggggagagaagctggcccatctatattctccctcaactagcaagtggatgaaatatcagggtcaatagttataagccacaaaagctgacagcttaattaagagaagttttgaaatatgtatttcatgaccaataattacaactgtaacttttctatttaaagaaggagaaaatttgaatttcttctctagctcaacatacacttctataattccattacatgaaccagagtaaagggtaagatggaaatgaagaatattttcttacccttttgtggttctatattggacacttaaaaatcatacacaacctaatcaaaagatgtaattctttaaaaaggtacgagaccaaaattcagaaaatctagactataacaaaatttctcaatttacattatcttaatatgcaattaattttcaccagtaaaatactatagtatgggtacaaatgcattgattagttctaattacaaaaatggctaatatataatactgtgtagtgtttatgatacatcagataatgttctaagtgctctgaaaatataaacttttaatcttttatacgaccctataaaataggtgttattctcactggagagatgagaaaacaggggttcagagatgtgaagtaatttgaccaaaggtcacaaagctgaagaatatgaaatccgggattctgattcaggcagtcttattccagaatcatgctcttaaccactatggaatactgcctctactgtaactattatacccaaaacccttaatcctaagtcatcaaaaggaagagcctctattttacacaatgaagaggcatttctaagaatagaaatttagggacgagcacagtggcttactcctttaatatcagcactttgagaggctgatatgggaggttcacttgaagtcaggagttcaaggtcagcttgggcaacatagtgaaacacagtctctacaaaatatttaaaaattagctgggtgtggtggcatgcatctatagtctcagctacttgggagacagagggaggaggcttgctcgagcccaggagttcgtggctatagtgagctatgatcatgccactgcactccagcctggacaacagagcaagaccctgtctctaaaaaagaaaagaaatttggaaatggtttattttgtattaacaatttataatttacactgaaatttattatgataaaacttttccctgtgttaaaaagctattaactttatgaaaaatttcttttaggtaaggttgattatatatacccacacacatacacaggttaaaagttagtttcatgtgacataataactagcattttgagcactacctgtttgcccagcactgttctaagtgctctacatgtattattgttaaattatcataacactatgaattatgtactataattaccccagctttacagatgaggagactaatccatggggaggttaagtaacttgtccaaggccagacagctagagccggcttttggacccacaccacagtctgactccagcacccatattcttaacaatttcaccatattaatatgtcaagattaagcagttttaaaggatgctattttctcacaaatttcttaatatgaacactcaataagaataatcactaatataagcatttagtatttttttaacactaagttggaagcatagtggaacatttatttttagaaatattattaattggctgggctcacgcttgtaatcggctgggctcatgcctgtaaattttgggaggccaaggtaaaagaattgcttgagcccagtatttccagaccagcatgggcaatacattaagacatcatctttaaaaaaaaaatgttattaatctcctctttttgttaaatgtatattatcaaaattgttactaagctaacaaacttcagaaaaacttatgatgggcaagctgcttgtgacattgaaggtatttaagattcaattctagtttggtcctagatgaccacatatccattgttccttcaacgagcacatggtaaagagcctagaacacagagacacagaacacagtggagaaaagggagtgaaatgtctttaatgacacttactatatatgggattttgtgacaatatacaaggatggttaagacatataaggtgatgcaaaaaaacatattaacaattatagtgacaaaaaatgaggagcatataattatacattgatttatacagagtaccagaggaacacagcattgagagccgtaacaccacctgagggagtggagaaaggcttcagagagaaagtgttttttggaatggatcactgtttccaaaagaactaaagtacagtttgagaaatgcatacttaattcattacttttttcccctcaactttaataataaatttacccaacaaaaaagtttatttttgacttgtaaatctcttaaaatcataaaaaagtaaaattagcttttaaaaacaggtagtcaccatagcattgaatgtgtagtttataatacagcaaagttaaatacaatttcaaattacctattaagttagttgctcatttctttgatttcatttagcattgatctaactcaatgtggaagaaggttacattcgtgcaagttaacacggcttaatgattaactatgttcacctaccaaccttaccttttctgggcaaatattggtatatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcattttatatgaaaattacaaatcggttaaattatacaatctagaacactatgtcattacactattgtaaattactgaaggtaagtaaaaagttaaaaaaaatttaaaactattctccagtgtttaaaacagattaaataatacagtaaatggaaaagatttattcatatgaaaatatgctgggctttttcttttaattgaagttcagaaaatcaaattttagagatagtacaatttaaataaaatgttaaggacaaaaatatgtgctatttgaaagaagcatacaaggggaaggaattgccaatattcatttttcaaatccattattagtttaaaaatttagattatgatagtgttacaggaaattaatagaaaagaaagaggaaagcaacttataaccaacctactctctatatccagacttttgtagaaaaacaagataatagcatcaaagaccttctccagaccgtggaagaccaatataaacaattaaaccaacagcatagtcaaataaaagaaatagaaaatcaggtaagtcagtattttaatggtatgtcccatctttcacacaggtctgtaaaaacactgaatcctaaaattatttacaagctttaactggatcatgagtaaaattatcacatcagcataactgttaaaattgcaggctctgaagctaataaactacctgcatttaaaccatggctctaaaactttgtgtgaccttgaataaattacttcacccctttatctctcagtttcctcacatatactacaaagataataacagaacttataggattattgtaagaaaaaaaattaattcatagcagccaatgtcatcttactaaaattcaaattagatcatgtttctctttgctcaaaaccacacaatagctttccatttcactcatattggctctttagaccaagattacccaacccttcgtcatctcactgacttcacctcctctactctagttattctgaccgctttaccagtattcaaacacatcaaacatactgccacctcaaagcctttgcccttgttgtttcctctaactggaacgctcttctgccctggtatctacgtggcccactctctgatttcccttagggtcgttatcaaacaaaaaattcccaatgaagacttacaaggtcacttaaccaaaaatcacaaccgcctggtcccatccctgaaaacttctacttccttagctacttttctcctgcacactcacctttatttaacataacataaattttagttatttatctcttctattcctgcactaaaatgtaagctctgtgaatacagggattttttccattatcttcatattttccattatttgtatatactccagaatatagaatactgtatggcacacagtaggcatttctgttgaattaataaatgtaatgtcatattcacacagaagcgtgtgctatgattattattacttggattactagaaatagtgtgcctcataattaaaggtcaacattcaacaatgtaattaatctacaatgtaaacatctggtgaagtgacagagggaagcacttgtttagaaaaaagctatgtcagaatccatgtattctaatatgcagtacaatagtttaaaaatattaataatactctcaaacagctattcaagaggattcaaaaaacataatataaactcagagaaactggtaaacaaaatcattttcaagagatataaaacaaatattattaccaatttccactaaacaaacataatgttagtagtgctgctaaaaggttttttatcaactacttttggtttccatactttccttcttatgatgttattattctaaattcttttcaattatatcttttactatgattaaatgaacctgctccccaaagcaaaatgttactatagtaatatacattgtgtctaaaaataaaaatgtgtgaagaaaccaaaacaatgaatttctgagttggaagaagagttagatcatttaactttctcatatttaaattaaaaaaacaaaactctaaaaatttaagtaactttaagatcacatagttacttagtagaaaagagtaatacccagcaagcaaactttacaatagatccttttaaataaggtcctaggaaatatcattcatgccagcatcaaaaaactaacactaataatgcaagatattatatattctgcttttcttactgtcaatgagaaaaactatcattcaataaattgcaaacccaacacacttaaataaaaataaaatgttactgctaaactaacgataaactactgaatatatagaaagtaagcaaacaaacttgccaacctgccaacatctacagatatgtttacaggtcaaaaattatcaaattatcaagaaagcctggttcaaattatgtattatgtctttatcacaggtctgaagatcagtaagacctaaaactgaaaattattaaacttaaaatctgaacagaatatcaaatatattttattcatataaataaaagaatacattacaatattctaagcaaagcagtctctacttttggccttgctctgttttccgaccaatgtctgcttttttgccttgctttatttttttatcttattaaataatgtccctgattaaatattttgagaacaggtaatctgtacaatctgaataacactgtttatctaaatatcaaacaccgttataacattatgaactgaaagacaaactgtacttctgacatccttactcagatttcccctaattgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggtaagacactttggtgggtttccttcttgaagctattattatcaaattccctattcttaggacttgttctagactaaaagatagttaagagatatccatcaaatacaatgtatcaacctaaactggatgctggggttctttttacaccctataaaagacatacctaagacaatcagagaaatacaaatatggacttgattattagataatatagaaggtttattaattttcttagatgtgatcatggtattgcagttttaaaggagaacaatctcctgtttaagagatacatgctgaaatatttacggagttaaaggtcactggactccagactggtgatagaacaagactctgtctctaaaaaataattaattttttaaaagaaaatagtttggtaagatgattcttacattcttaaataacacgccatctaagaaaaatgctttaacataaacattactgaaaaaatgctacatttgccacaacttcataaaatgtcaagtgaaatctcaagctccaaagatattattcctattactaaatctgatgtaataacattttattgattctaggcattcctgctgaatgtaccaccatttataacagaggtgaacatacaagtggcatgtatgccatcagacccagcaactctcaagtttttcatgtctactgtgatgttatatcaggtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcattcattatattcaggtagtccatggacattaattcaacatcgaatagatggatcacaaaacttcaatgaaacgtgggagaactacaaatatggttttgggaggcttgatggtaaggggactacattcaatcattcattcacttgctaatctacaaatatttactgagaacctcttatggaccaggtattaggaaaagtagtaacgaacgagaagcagtctcagccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttaaaaattttgtattcaaactaccagtgaaagccctacctagaaggtatactcagtgataagttttgtagctccaaatcttctaatagtgagtgtaaccccaaaataaaaggctgacaggtaagtcgagaatactcacttaattctggtaagaaagcaacccatttgtacttgtatttaccagcaatccttaaaatgaagcttcctactaactcaatagcaataagacaatagtgaatgtttaatgaaaacagtattttataaatactttaataaaaaggattgtgatgaagaacaatctatttatatttgttatttgtttttaattccaataaaaataatttttaaaattacagaaaaaagttattaagaaccatgcttttaaatttaaaatgattttttaaatttattcctgtctttttctacaaagaaagcatacattaagcaaataccaaaggccaggtttacatttgaagaaagtgacattattattactcaagtctctaggaatacttaacacatctcttgactgtatatggatgttaataaatagctgacagtaaagtttatccatataaagacttgcaaatattcctctaccaatgacgagactttaaaatatctataataatgtaacacatttcactggtgaaacatgtcttgtcatatgcattatagaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaaaaaaaaaaaaactctcataggacatgtttcattttgttcctttcaggagtagtaaattagacgttttccccatataaagcttttttctaccagaaagatacttctggtagaagaagagaaaggagctctttatggttcacacgactgtctcctgtcctaactactttgcttaaagtgctcaaattccatcactactcacagttgtctaatctaagtctaatcccctttgatctctcagactaccttcccttttatctctctactacttaataataagaatatctttttttcaaacttgaccttcattttgctttcacaatactatactctccatggattatcccttatctgaatccatctttataaccctattcctttctcatatttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaattcaacataccaaaaataaaaggccaggcacggtggctcacacctgtaatcccaggactttgggaggctgaggcaggtggatcacctgaggtcaggagtctgaccagcctgaccaatatggtgaaaccccgtctctacctaaaatacaaaaattagccaggcgtggtggcatgtgcctacagtcccagctactcaagaggctgagacaggagaatcgcttgaacccaggaggcggaggttgcagtgagctgagatcacaccaatgcactgggtgacagaacaagactgactcaaaaaaaaataaataacaaattccccagccccttactgctactgctatccctttctacccacctttccctcctttatactctttcacaccatcttcctcacttctttatatccattaatatgaccagcatgttcccagtcacagaagcctggaacccggaagacatctctggcttttcactcaactttgtaaactacctcttttgtatcataagccaccaagttcaatacaatcttctcttgaaacgtctcttaatcttataagctttcttccccaaagactgtctttaacttcagtgctagattatataagtagtctcttctttcctcctaattttacgtccctctccctgtcaatcttccgaaaaggaatttgtaatggctgcatactgcctggacctgtgtctttcaagctcatctactgaagaagtgtaacagcagaggataatgaaaacaaatccttttattgtctggagttacaggataaaataacttactatatgcacaaatttctttcagaatcttattgggatcttagcttaaatcttagaattttactttaaaattgcatatgaattgtgttttatactttataaatctatcttcatgcctgcagtggctcacacctgtaatccaagtattttgggaggccggggcgggagtactgcttgaacccaggagtccaagatcagcctgtgcaacacggcaaaactccacctctacaaaaaatacaaaaattagctgggtgtggtggcaggtgcctgtaatcccaactacttgggaggctgaggcaggagaatcgctggagcctgggaagtcaagcctgcagcgaaccatgatcctaacactgcattctagcctgggcaacagagtgagactctgtctcaaaaaaaatcttcatataaaaatatttatttccccccaagtatttaaaaagtgatgttcctagaagatgtgtcatgtttatcctgtgaacttgcacgtcccatatagttgtgccctcacaagaatgtatactccaattagaagagtataggcctttggaacaaaatccaaaatccttccaggttttcaaaagtctctatcacctggccccaaattacctcttcagccattttttcccacaacacaaaccttctgctctcatcaaaacgatctacttttaaacatctcctctatgccttcctaatgtattccatttgtctagaatgtctcc

SEQ ID NO: 3 - DNA, 13000 bp, Macaca mulatta
  misc_feature (4504)..(4523): n is a, c, g, or t
  misc_feature (5370)..(5795): n is a, c, g, or t
  misc_feature (7498)..(7517): n is a, c, g, or t
  misc_feature (9552)..(9895): n is a, c, g, or t
cccagctactgaggaggctgaggcaggagaatggcgtaaacccgggaggcggagcttgcagtgagctgagatctggccactgcaccccagcctgggcaacagagcaagactccgtctcaaaaaacaaaacaaaacaaaacaaaacaaaacaaaacaaagaatgtagtatatcaaaaagaggtaaccagtactacatatacattctgcacttggaaaatccctatatgttgattttatcattctcttagtcattcaataaacattgcttctacaatgtgtgaggcattactgtactaaagcattataaggaatatacattaaaaacacatacaaatcttgccaataaacggcttatagtataataggggagagaagttggcccatctatcttctccttcaactagcaagtagatgaaatatcagggtcaatagttgtaagccataaaagctgacagcttagttaagagaagttttgaaatatgtatttcatggccaaataattacaactgtaacttttctatttaaagaaggagaaaatttgaatttcttctctagctcaacatacacttttataattctataacatgaaccagagtaaagggtaagatggaaatgaagaatattttcttacccttttgtggttccatattggacacttaaaaatcatacacaacctaatcaaaagacataattcattaaaaaggtacgagaccaaaactaaaaaaatctagactataacaaaatttcccaatttacattatcttaatatgcaattaattttcaccagtaaaatactatactatgggtacaaatgcattgattagttctaattacaaaaatggctaatatataatattatgtagtgtttatgacacaccaggtaatgttctaagtgctttgaaaatataaacttttaatctttatacaaccctataaaataggtgtcattctcactggacagatgagaaaacaggggttcagaaatgtgaagtaatttgaccaaaggtcacaaaactgaagaatatcaaatccaggattctgattcaggcagtcttgttccagaatcatgctcttaaccactatggaatactacctgtattatagtattacatatactgtactataactattacacccaaaacccttaatactacctgtactataactattatacccaaaatcctgagtcatcaaaaagaagagcctctattttatacaatgaagaggcatttctaagaatagaaatttagggacgagcacagtggcttactcctgtaatatcagcactttgagaggctgatgtgggaagttcacttgaagtcaggagttcgaggccagcttggacaacatagtgagacccactctctacaaaatatttaaaaattagctgggcgtgttggcatgcatctatagtctcagctactggggaggctgagggaggaggctcactcaagcccaggaattcgtggctatagtgagctatgatcatgccactgtactccagcctggacaacagagcaagaccctgtctctaaaaaaaagaaaagaaaagaaatttggaaatggttcattttgtagtaacaatttataatttacactgaaattcattatgataaaacttttccctgtgttaaaaagatattaactttatgaaaaatttattttaggtaaggttgattatatatactcacacacatacacaggttaaaagttagtttcatgtgacataataactagcattttgagcactacctgtttgcccaacactgttctaagtgctctacatgtattattgttaaattatcataacactatgaattatgtactataattaccccagctttacagatgaggagactaatccaaggggaagttaagtaacttgtccaaggtcagacagcgagagctggctttggaccccactacagtctgactccagcacccatattcttaacaatttcaccatattaatatgtcaagattaagtagttttaaaggatactattttctcacaaagttcttaatatgaacacttaataagaataatcactaatattagtatttttctttttaacactaagttggaagcacagtggaacatttatttttagaaatattattaattggctgggctcacgcctgtaattgactgggctcatgtccgtaaattttgggaggccaaggcaaaagaatcgcttgagcccaatagttccagaccagcataggcaatacattaagacatcgtctttaaaaaaacaaagttattaatctcttctttttgttaaatgtatattatcaaaattgttacactaagctcacaaacttcagaaaaacttatgatgggtaagttgcttgtgacattgaaagtatttaagattcaattctgtttgatcctagaagaccacatatccattgttccttcagtaaacacatgataaagagcctagaacagagagacagagaacacagtggagaaaggggagtgaaatgtctttaatgacacttactatatgtgggattttgtgataatatacaaggatgattaagacatataaggtgatgcaaaaaaaccatattaacaattatagtgacaaaaataaggagtacataattatacgttgatttatacagagtaccaaaggaatacagcattgagagctgtaccactacccgagggaatggagaaaggcttcagagagaaagtgttttttgggatggatcaatgtttccaaaagaaccgaagtgcagtttgagaaacgcatacttaattaattcttttcctcaactttaataataaatttactcaacaaaaaagtttatttttgacttgtaaatctcttaaaatcataaaaaagtaaaatcagcttttaaaaacaggtagtcaccatatcattgaatgtgcagtttataatacagcaaagttaaatacaatttcaaattacctattaagttagttgctcatttctttgatttcatttagcattgatgtaactcaatgtggaagaaggttacattcgtgcaagttaacatggcttaatgattaactatattcacctgccaaccttgccttttctgtggcaaatattggtatatatagagttaagaagtctaggtctgcttccagaagaacacagttccacgttgcttgaaattgaaaatcaggataaaaatgttcacaattaagctccttctttttattgttcctctagttatttcctccagaattgaccaagacaattcatcatttgattctgtatctccagagccaaaatcaagatttgctatgttagacgatgtaaaaattttagccaatggcctccttcagttgggacatggtcttaaagactttgtccataagactaagggccaaattaatgacatatttcaaaaactcaacatatttgatcagtctttttatgatctatcactgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacatccagaagtaacttcacttaaagtaagtagaaaataaagagggttcatgtttatgttttcaatgtggaacattaaaaaaaaatatttctaaggcatgctacttgaaatactttgttgcattgttggaatacttttttttccaagaaaaataatctccagaaaataaaatttcccattataattttgttagtttttgtttccctaatgttatatatgaaaacactgaaactttacattttatatgaaaattacaaattggttaagtaacacaatctagaacactatgtcattacactattgcaaattactgaaggtaagtaaaattttttaaaaatttaaaactattctctagtgtttaaaacagattaaagtaatacagtaaatggaaaagatttattcctattaaaatatgctgggctttttctcttaattgaagttcagaaaaacaaatcttagagatagcacaatttaaataaaatgttaagaacaaaaatacatgctatttgaaagaagcatacaaggggaaggaattgccaatattcatttttcaaatccattattagtttaaaaatttagattatgatagtgttacaggaaattaaaactctaatagaaaagaagaaagtaacttataaccaatctaatctctatattcagagttttgtagaaaaacaagataatagcatcaaagaccttctccagactgtggaagaacaatataagcaattaaaccaacagcacagtcaaataaaagaaatagaaaatcaggtaagtcaatattttaatggtatgtcccatctttcacacaggtttgtaaaacattgaatcctaaaattatttacagctttaactggatcatgannnnnnnnnnnnnnnnnnnngaaaataattaattcatagcagccaatgtcatcctattaaaattcaaattagatcatgtttctccttgctcaaaaccacacaatagctttccatctcactcatattggctctttagaccaagattacccgacccttcatcatctcactgacttcacctcctctactctagtcattttgatcgctttaccggtattcaaacacatcaaacatgctgccacctcgaagcctttgcccttgttgtttcctctatctggaatgctcttttgtcctggtatctacagggcccactctttgatctcccttagggtcgttatcaaacataaaattctcaatgaagatttccaaggtcacttaaccaaaaattacaactgcctggtcccatccctgaaaacttctacttccttaactacttttctcctgcacactcacctttatttaacataaattttagttatttatctcttctattcctgcactaaaatgtaagctctgtgaataaaggggtttttttccattatcttcatattttccattatttgtatatactccagaatatagaatactgtatggcacatactaggcatttctgttgaattaataaatgtaatgtcatattcacacagagtgtgtgctataattattattacttggattactagaaatagtgtgcctcataattaaaggtcaacattcaacaacgtaattaatctacaatgtaaacaactggtgaagtgaggggggaagcacttgtttagaataaagctatgtcagaatctaagtattctaatatacagtaaatagttaaaaaatattaataatactcttaaacagtcattcaagaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgttaaaatcacatagttacttagtagaaaagagtaatatccagcaagtaaactttacaatagatccttttaaataaggtcctaggaaatgtcatttatgccaggatcaaaaaactaacactcataatgcaagatattatatattctgcttttcttactgtcaatgagaaaaactatcattcaataaattgcaaacccaacacacttaaataaaatgttattgcaaaactaacgataaactactgaatatatggaaagtaagcaaataaacttgccaacctgccaacatctacagatgtgtttacaggtcaaaaattatcaaattatcaagaaagccaggttcaaattatgtattatgtctttaaagcaggtctgaagatcagtaagacctaaaactgaaaattattgaacttaaaatctgaacagaatatcaaacatattctattcatataaaaaaaaatacattacaacattctaagcaaagcagtctctacttttggccttgttctgttttctgaccaatgtctgcttttttgccttgttttatttttttaatttattaaataatgtccctgattaaatattttgagaacaggtaatctgtacaatctgaataacactgtttatctaaatatcaaacaccataacattatgaactgaaagacaaactgtacttttgacatccttactcagatctcccctaattatgtattcagtatcattttaaaaaacagatttatattcttttatcagctcagaatgactaatattcaagaacccacagaaatttctctatcttccaagccaagagcaccaagaactactccctttcttcagctgaatgaaataagaaatgtaaaacatgatggtaagacactttggtgggtttccttcttgaagctattatcaaattccctattcttaggacttgttctagactaaaagattaagagatagccatcaaatacaatggatcatcctaaattggatcctggggttcttcttctaccctataaaagatatacctaagacaatcacagaaatataaatatggacttgattattagataatatagaaggtttattaattttcttagacgtgatcatggtattgcaattttaaaggagaacaacctcctgtttaagagatacatgctgaaatatttaaggagttaaaggtcactggactcctggctgggtgacagaacaagactctgtctctaaaaaaataattttttaaaagaaaatagtttggtaagaatgattcttacattcttaaataacatgccatcgaagaaaaatgctttaacataaacattactgaaaaaaatgctacatttgccacaatttcataaaatgtcaagtgaaatctcaagctccaaagacattattcctattactaaatctgatgtaataacattttattgattctaggcattcctgctgattgtaccaccatttacaatagaggtgaacatataagtggcatgtatgccatcagacccagcaactctcaagtttttcatgtctactgtgatgttgtatcaggtaaaacctgtctaaggagaatagacagtagttagttcaagttactcagtatgtattaggaagattaacctggttataattgttttatacatatatatatatgaaatatatgtaacatgagtattagtataaatctaatacttttatcttgnnnnnnnnnnnnnnnnnnnnatggatcacaaaacttcaatgaaacgtgggagaactacaaatatggtttcgggaggcttgatggtaaggtgactacattcaatcattcattcatttgctaatctacaaatatttactgagaacctattgtggactgggcattaggaaaagtagtaatgaagaagcagcagtctcagccttcatataatttattatcaaacaattacacatttgttagtaaattattacaactgttataatttgatttatatttatcacagttacatgtctgttcttaaatatacttatcacaatttaatttgatggcttacaatgatcataactataattattaaagacaattctgattaaatgttatataagtagtaactgttacaaataagctgtgaaaagaaccactcctagcattagtcactctattctctcattaacgttttacgtatcaattaattggaagttaaaaggaccaagaaactcagacatacagtataaattttaaaatttcaattatttaaatgtaatatatagaatgtgtggcttataatgaattagttaactcaatgcaaattattctgattacaaaataatgttaaataagcaagataaaataacagatgtttaaaatccaaaaagcacatacaaaaatccatgaatgatgtctaagtactcacttataaagtagaagacattcattattatatcaaatttttaaatgctcagtactatttgcccatttaaaaattttgtattcaaattacccgttaaagccctacctagatggtatactccgtgatatgttttgtagctccaaatcttctaatagtgagtgtaaccccaaaataaaaggctgacaggtaagttaagaatactcacttaattctggtaagaaactaacccatttgtacttgtatttaccagcaatccttaaaatgaagcttcctactaactcaatagcaataagacaacagtgactgtttaatgaaaacagtaatttattaagcattttactaaatactttaataaaaaggattgtgataaaaagtctatttatatttgttatttatgtttttaattccaaataaaaataatttttaaaattatagaaaaaagttattaagaaccatgctttttcatttaaaatgatttttaaaatttattcctgtctttttctacaaagaaaacatatattaagcaaataccaaaggccaggtttagacttattattactcaagtctctgggaatacttaacaaaaatctcttgactgtatatggatgttaataaatacctgatagtaaagtttatccatataaagacttacaagaaaatattcctctaccaatgacgagactttaaagtatctataataatgtaacatatttcactggttaaatatgtcttgtaatatgcattatagaaaggataatctgactttcagttctattaatatttttaacattattgtgcatatagatatcttcaataaaattgttttaaaaggtattattttaagatactctaaaatgatcaagggattcaagactaaacaactcaattagttgcaccaataaaaaacacttaaaaaaacagtgtccaacctgtagttaataattcacagatttttaaaacttttcttttcaggagaattctggttgggcctagagaagatatactccatagtgaagcaatctaattacgttttacgaattgagttggaagactggaaagacaacaaacattatattgaatattctttttacttgggaaatcacgaaaccaactatacgctacatgtagttaagattactggcaatgtccccaatgcaatcccggaaaacaaagatttggtgttttctacttgggatcacaaagcaaaaggacacttcagctgtccagagagttattcaggtatctttttctgataacaatactttattttcatatcttcaaagtatctgcccacattattagctattatctgcaatgacaacttttaaaaatccgaatcccaaataagcgttttctttctagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactataatatttattaaaaaggaagataaactcatggggaaatacagtaactacatacgagtctgtacccactaaactgcgtatctatctcctttaggaggctggtggtggcatgatgagtgtggagaaaacaacctaaatggtaaatataacaaaccaagaacaaaatctaagccagagcggagaagaggattatcctggaagtctcaaaatggaaggttatactctataaaatcaaccaaaatgttgatccatccaacagattcagaaagctttgaatgaactgaggcaaatttaaaaggcaataaattaaacattaaactcattccaagttaatgtggtttaataatctggtattaaatccttaagagaaggcttgagaaatagatttttttatcttaaagtcactgtcaatttaagattaaacatacaatcacataaccttaaagaataccatttacatttctcaatcaaaattcctacaacactatttgttttatattttgtgatgtgggaatcaattttagatggtcgcaatctaaattataatcaacaggtgaacttactaaataacttttctaaataaaaaacttagagactttaattttaaaagtcatcatatgagctaatatcacaattttcccagtttaaaaaactagttttcttgttaaaactctaaacttgactaaataaagaggactgataattatacagttcttaaatttgttgtaatattaatttcaaaactaaaaattgtcagcacagagtatgtgtaaaaatctgtaatataaatttttaaactgatgcctcattttgctacaaaataatctggagtaaatttttgataggatttatttatgaaacctaatgaagcaggattaaatactgtattaaaataggttcgctgtcttttaaacaaatggagatgatgattactaagtcacattgactttaatatgaggtatcactataccttaacatatttgttaaaacgtatactgtatacattttgtgtattttaatacttaatactatgaaaacaagtaattgtaaacgtatcttgtcagattacaataggaatgaacatattggtgacatcgagttaaagtttatatttcccctaaatatgctgcgattccaatatattcatgtaggttttcaagcagaaataaaccttgtaacaagttactgactaaacagcctgacaagtatgtatatatgtttaaaattcaataaataaagacccagtcttctaaattataaaaatttaaattagtcttgcacaaattaaattattcatcacaaaagatgtattgttatttttaagtcatttaagccctaaatccctaaagattagatacaaatttttttttgccagagtataaattgtcagaatttatttttaaatatattttttaaaactaccagtaagaaattttaaattaaacccatttgttaaaggatatagtgcccaagttatacggtgacctacctttgtcaatatttagcattatgtatttcaaattatccaatatacatgtcatatatatttttatatgttgcatatataaaagatatacacgatttatgtgaatcctatgtaaatattttgttccagaaaagtacaaaataataaaggtaaaaataatccataattttcaggaccacagactaagctgtcaaaattaacattgattttttttagggccagaataccaaaatagctcctctcttccccaaaaattggacaatttcaaatgcaaaataattcattatttaatatatgagttgcttccactatttggtttcctttaaaaaaaaaaaaaaaacactctcataggacatgtttcattttgttccttttaggagtagtaaattagattttttccccatacaaagctttcttttaccagaaagatacttctggcagaagaggagaaaggagctcttttctttatggttcacacgactgtctcctgtcctcactactttgcttaaagtgctcaaattccaccactaactcacagttgtctaatctaagcaaagtctaatcccctttgatctctgagtctaccttccctttcatctctctactacttactaatgtgaatatctttttttcaaacttgaccttcattttgctttcacaatactatactctccatggattttcccttacttgaatccatctttataaccctattcctttctcatatttagtactgtgggccaatggacaacctttaatcatcttttctacactgactctcagatattctatctgctctcacggactcatctatgtaccatgaataaagttccaaaatctacgtattcatcctaagtctctttccagttccccttcttacattgcctatctgccatttctccctttaataacctatacttcacttaaattcaacatatcaaaaataacaggccgggcacggtggctcatgactgtaatcccagcactttgggaggccgaggcgggtggatcacctgaggtcaggagtttcagaccagcctgaccaacagggtgaaaccccgtctccacttaaaatacaaaaattagccaggtgtggtggcatgtgcctatagtcccagttactcaagaggctgagacaggagaattgcttgaacccaggaggcggaggttgcagtgagctgagatcacaccactgcactccatcctgggtgacagaacaagactgactcaaaaaaataaataattcaccagcccctgactgctactgctatctctttctacccaactttccctcctttcgactctgtcacaccatctttctcacttctttatatccattaatatgaccagcatgttcccagtcacagaagcctgaaacctggaagacatctctagcttttccctcaacttcgtaaactacttcttttgtataagccaccaagttcaatacaatcttctcttgaaacatctcttaatcttataagctttcttccccaaagtctgtctttaacttgagtgctagattatattagtctcctctttcctcctaattttatgtccctctccctgtcaatcttctgaaaagaaatttgtaatggctgcatattgcttgga

SEQ ID NO: 4 - DNA, 25 bp, Artificial sequence
  Primer
ccgtggaagaccaatataaacaatt

SEQ ID NO: 5 - DNA, 28 bp, Artificial sequence
  Primer
agtccttctgagctgattttctatttct

SEQ ID NO: 6 - DNA, 21 bp, Artificial sequence
  Probe
aaccaacagcatagtcaaata

SEQ ID NO: 7 - DNA, 23 bp, Artificial sequence
  Primer
cttcaatgaaacgtgggagaact

SEQ ID NO: 8 - DNA, 22 bp, Artificial sequence
  Primer
tctctaggcccaaccaaaattc

SEQ ID NO: 9 - DNA, 24 bp, Artificial sequence
  Probe
aaatatggttttgggaggcttgat

SEQ ID NO: 10 - DNA, 21 bp, Artificial sequence
  Primer
aaattttagccaatggcctcc

SEQ ID NO: 11 - DNA, 21 bp, Artificial sequence
  Primer
tgtcattaatttggcccttcg

SEQ ID NO: 12 - DNA, 32 bp, Artificial sequence
  Probe
tcagttgggacatggtcttaaagactttgtcc

SEQ ID NO: 13 - DNA, 27 bp, Artificial sequence
  Synthetic Oligonucleotide
gcgtttgctcttcttcttgcgtttttt

SEQ ID NO: 14 - DNA, 20 bp, Artificial sequence
  Synthetic Oligonucleotide
tgaattaatgtccatggact

SEQ ID NO: 15 - DNA, 20 bp, Artificial sequence
  Synthetic Oligonucleotide
agttcttggtgctcttggct

SEQ ID NO: 16 - DNA, 20 bp, Artificial sequence
  Synthetic Oligonucleotide
gttgtctttccagtcttcca

SEQ ID NO: 17 - DNA, 20 bp, Artificial sequence
  Synthetic Oligonucleotide
gctttgtgatcccaagtaga

SEQ ID NO: 18 - DNA, 20 bp, Artificial sequence
  Synthetic Oligonucleotide
ggttgttttctccacactca

SEQ ID NO: 19 - DNA, 20 bp, Artificial sequence
  Synthetic Oligonucleotide
accttccattttgagacttc

SEQ ID NO: 20 - DNA, 20 bp, Artificial sequence
  Synthetic Oligonucleotide
tacacatactctgtgctgac

SEQ ID NO: 21 - DNA, 20 bp, Artificial sequence
  Synthetic Oligonucleotide
tttcagcatgtatctcttaa

SEQ ID NO: 22 - DNA, 20 bp, Artificial sequence
  Synthetic Oligonucleotide
accaggttaatcttcctaat

SEQ ID NO: 23 - DNA, 20 bp, Artificial sequence
  Synthetic Oligonucleotide
agttatgatcattgtaagcc

SEQ ID NO: 24 - DNA, 20 bp, Artificial sequence
  Synthetic Oligonucleotide
ggagtggttcttttcacagc

SEQ ID NO: 25 - DNA, 20 bp, Artificial sequence
  Synthetic Oligonucleotide
tggtccttttaacttccaat

SEQ ID NO: 26 - DNA, 20 bp, Artificial sequence
  Synthetic Oligonucleotide
gcattgagttaactaattca

SEQ ID NO: 27 - DNA, 20 bp, Artificial sequence
  Synthetic Oligonucleotide
catccatatacagtcaagag

SEQ ID NO: 28 - DNA, 20 bp, Artificial sequence
  Synthetic Oligonucleotide
cacttgtatgttcacctctg

SEQ ID NO: 29 - DNA, 20 bp, Artificial sequence
  Synthetic Oligonucleotide
tctattcgatgttgaattaa

SEQ ID NO: 30 - DNA, 20 bp, Artificial sequence
  Synthetic Oligonucleotide
ttgattttcaatttcaagca

SEQ ID NO: 31 - DNA, 20 bp, Artificial sequence
  Synthetic Oligonucleotide
ggctctggagatagagaatc

SEQ ID NO: 32 - DNA, 20 bp, Artificial sequence
  Synthetic Oligonucleotide
tcttgattttggctctggag

SEQ ID NO: 33 - DNA, 20 bp, Artificial sequence
  Synthetic Oligonucleotide
gtcattaatttggcccttcg

SEQ ID NO: 34 - DNA, 20 bp, Artificial sequence
  Synthetic Oligonucleotide
ttcactggtttgcagcgata

SEQ ID NO: 35 - DNA, 20 bp, Artificial sequence
  Synthetic Oligonucleotide
cttagattttgctcttggtt

SEQ ID NO: 36 - DNA, 20 bp, Artificial sequence
  Synthetic Oligonucleotide
gcttagattttgctcttggt

SEQ ID NO: 37 - DNA, 20 bp, Artificial sequence
  Synthetic Oligonucleotide
ggcttagattttgctcttgg

SEQ ID NO: 38 - DNA, 20 bp, Artificial sequence
  Synthetic Oligonucleotide
gctcatatgatgccttttaa

SEQ ID NO: 39 - DNA, 20 bp, Artificial sequence
  Synthetic Oligonucleotide
agctcatatgatgcctttta

SEQ ID NO: 40 - DNA, 20 bp, Artificial sequence
  Synthetic Oligonucleotide
tagctcatatgatgcctttt

SEQ ID NO: 41 - DNA, 20 bp, Artificial sequence
  Synthetic Oligonucleotide
tattagctcatatgatgcct

SEQ ID NO: 42 - DNA, 20 bp, Artificial sequence
  Synthetic Oligonucleotide
ccacaaatatgttcattctt

SEQ ID NO: 43 - DNA, 20 bp, Artificial sequence
  Synthetic Oligonucleotide
tgccacaaatatgttcattc

SEQ ID NO: 44 - DNA, 20 bp, Artificial sequence
  Synthetic Oligonucleotide
taaactttaactcgatgcca

SEQ ID NO: 45 - DNA, 20 bp, Artificial sequence
  Synthetic Oligonucleotide
acgaggtttatttctacttg

SEQ ID NO: 46 - DNA, 20 bp, Artificial sequence
  Synthetic Oligonucleotide
catgcttgtcaggctgttta

SEQ ID NO: 47 - DNA, 20 bp, Artificial sequence
  Synthetic Oligonucleotide
tacatgcttgtcaggctgtt

SEQ ID NO: 48 - DNA, 20 bp, Artificial sequence
  Synthetic Oligonucleotide
tccaactcagaaattcattg

SEQ ID NO: 49 - DNA, 20 bp, Artificial sequence
  Synthetic Oligonucleotide
ttgctgggtattactctttt

SEQ ID NO: 50 - DNA, 20 bp, Artificial sequence
  Synthetic Oligonucleotide
tttgcttgctgggtattact

SEQ ID NO: 51 - DNA, 20 bp, Artificial sequence
  Synthetic Oligonucleotide
tggcatgaatgatatttcct

SEQ ID NO: 52 - DNA, 20 bp, Artificial sequence
  Synthetic Oligonucleotide
gcaataccatgatcacatct

SEQ ID NO: 53 - DNA, 20 bp, Artificial sequence
  Synthetic Oligonucleotide
actccgtaaatatttcagca

SEQ ID NO: 54 - DNA, 20 bp, Artificial sequence
  Synthetic Oligonucleotide
tggcaaatgtagcatttttt

SEQ ID NO: 55 - DNA, 20 bp, Artificial sequence
  Synthetic Oligonucleotide
aagccatacattctatatat

SEQ ID NO: 56 - DNA, 20 bp, Artificial sequence
  Synthetic Oligonucleotide
tcagctatttattaacatcc

SEQ ID NO: 57 - DNA, 20 bp, Artificial sequence
  Synthetic Oligonucleotide
gaggaatatttgcaagtctt

SEQ ID NO: 58 - DNA, 20 bp, Artificial sequence
  Synthetic Oligonucleotide
ttggtagaggaatatttgca

SEQ ID NO: 59 - DNA, 20 bp, Artificial sequence
  Synthetic Oligonucleotide
accagtgaaatgtgttacat

SEQ ID NO: 60 - DNA, 20 bp, Artificial sequence
  Synthetic Oligonucleotide
tgaaagtctgattatccttt

SEQ ID NO: 61 - DNA, 20 bp, Artificial sequence
  Synthetic Oligonucleotide
atttaatgggtacagactcg

SEQ ID NO: 62 - DNA, 20 bp, Artificial sequence
  Synthetic Oligonucleotide
ataccatgatcacatctaag

SEQ ID NO: 63 - DNA, 20 bp, Artificial sequence
  Synthetic Oligonucleotide
gacctttaactccgtaaata

SEQ ID NO: 64 - DNA, 20 bp, Artificial sequence
  Synthetic Oligonucleotide
tctggagtccagtgaccttt

SEQ ID NO: 65 - DNA, 20 bp, Artificial sequence
  Synthetic Oligonucleotide
atgtaagaatcatcttacca

SEQ ID NO: 66 - DNA, 20 bp, Artificial sequence
  Synthetic Oligonucleotide
agcatttttcttagatggcg

SEQ ID NO: 67 - DNA, 20 bp, Artificial sequence
  Synthetic Oligonucleotide
cattttatgaagttgtggca

SEQ ID NO: 68 - DNA, 20 bp, Artificial sequence
  Synthetic Oligonucleotide
cacttgacattttatgaagt

SEQ ID NO: 69 - DNA, 20 bp, Artificial sequence
  Synthetic Oligonucleotide
tcctggtccttttaacttcc

SEQ ID NO: 70 - DNA, 20 bp, Artificial sequence
  Synthetic Oligonucleotide
gacatcattcatggattttt

SEQ ID NO: 71 - DNA, 20 bp, Artificial sequence
  Synthetic Oligonucleotide
agtacttagacatcattcat

SEQ ID NO: 72 - DNA, 20 bp, Artificial sequence
  Synthetic Oligonucleotide
ggtcaaatagtactgagcat

SEQ ID NO: 73 - DNA, 20 bp, Artificial sequence
  Synthetic Oligonucleotide
ggtagtttgaatacaaaatt

SEQ ID NO: 74 - DNA, 20 bp, Artificial sequence
  Synthetic Oligonucleotide
ctctgttataaatggtggta

SEQ ID NO: 75 - DNA, 20 bp, Artificial sequence
  Synthetic Oligonucleotide
ttcttggtgctcttggcttg

SEQ ID NO: 76 - DNA, 20 bp, Artificial sequence
  Synthetic Oligonucleotide
ggtacattcagcaggaatgc

SEQ ID NO: 77 - DNA, 20 bp, Artificial sequence
  Synthetic Oligonucleotide
ggacattgccagtaatcgca

SEQ ID NO: 78 - DNA, 20 bp, Artificial sequence
  Synthetic Oligonucleotide
cactcatcatgccaccacca

SEQ ID NO: 79 - DNA, 20 bp, Artificial sequence
  Synthetic Oligonucleotide
ctccacactcatcatgccac

SEQ ID NO: 80 - DNA, 20 bp, Artificial sequence
  Synthetic Oligonucleotide
tttctccacactcatcatgc

SEQ ID NO: 81 - DNA, 20 bp, Artificial sequence
  Synthetic Oligonucleotide
gctgacgatttttagttttg

SEQ ID NO: 82 - DNA, 20 bp, Artificial sequence
  Synthetic Oligonucleotide
cacatactctgtgctgacga

SEQ ID NO: 83 - DNA, 20 bp, Artificial sequence
  Synthetic Oligonucleotide
tttacacatactctgtgctg

SEQ ID NO: 84 - DNA, 20 bp, Artificial sequence
  Synthetic Oligonucleotide
gctttcttaccagaattaag

SEQ ID NO: 85 - DNA, 20 bp, Artificial sequence
  Synthetic Oligonucleotide
gttgctttcttaccagaatt

SEQ ID NO: 86 - DNA, 20 bp, Artificial sequence
  Synthetic Oligonucleotide
ataccagattattagaccac

SEQ ID NO: 87 - DNA, 20 bp, Artificial sequence
  Synthetic Oligonucleotide
gcttcattttaaggattgct

SEQ ID NO: 88 - DNA, 20 bp, Artificial sequence
  Synthetic Oligonucleotide
gcttaatgtatgctttcttt

SEQ ID NO: 89 - DNA, 20 bp, Artificial sequence
  Synthetic Oligonucleotide
gttaagtattcctagagact

SEQ ID NO: 90 - DNA, 20 bp, Artificial sequence
  Synthetic Oligonucleotide
tccatatttgtatttctctg

SEQ ID NO: 91 - DNA, 20 bp, Artificial sequence
  Synthetic Oligonucleotide
cgtaagtttatcttcctttc

SEQ ID NO: 92 - DNA, 20 bp, Artificial sequence
  Synthetic Oligonucleotide
cacattaacttggaatgagg

SEQ ID NO: 93 - DNA, 20 bp, Artificial sequence
  Synthetic Oligonucleotide
ccagattattagaccacatt

SEQ ID NO: 94 - DNA, 20 bp, Artificial sequence
  Synthetic Oligonucleotide
taccagattattagaccaca

SEQ ID NO: 95 - DNA, 20 bp, Artificial sequence
  Synthetic Oligonucleotide
gctttctcttaaggatttaa

SEQ ID NO: 96 - DNA, 20 bp, Artificial sequence
  Synthetic Oligonucleotide
ctcaagctttctcttaagga

SEQ ID NO: 97 - DNA, 20 bp, Artificial sequence
  Synthetic Oligonucleotide
tctcaagctttctcttaagg

SEQ ID NO: 98 - DNA, 20 bp, Artificial sequence
  Synthetic Oligonucleotide
ccatttgtttaaagacagcg

SEQ ID NO: 99 - DNA, 20 bp, Artificial sequence
  Synthetic Oligonucleotide
acttagtagtcatctccatt

SEQ ID NO: 100 - DNA, 20 bp, Artificial sequence
  Synthetic Oligonucleotide
gacttagtagtcatctccat

SEQ ID NO: 101 - DNA, 20 bp, Artificial sequence
  Synthetic Oligonucleotide
tgacttagtagtcatctcca

SEQ ID NO: 102 - DNA, 20 bp, Artificial sequence
  Synthetic Oligonucleotide
gtcaatgtgacttagtagtc

SEQ ID NO: 103 - DNA, 20 bp, Artificial sequence
  Synthetic Oligonucleotide
accatataacttgggcacta

SEQ ID NO: 104 - DNA, 20 bp, Artificial sequence
  Synthetic Oligonucleotide
ggtcaccatataacttgggc

SEQ ID NO: 105 - DNA, 20 bp, Artificial sequence
  Synthetic Oligonucleotide
gacaaaggtaggtcaccata

SEQ ID NO: 106 - DNA, 20 bp, Artificial sequence
  Synthetic Oligonucleotide
gccaatatgagtgaaatgga

SEQ ID NO: 107 - DNA, 20 bp, Artificial sequence
  Synthetic Oligonucleotide
tttctaaacaagtgcttccc

SEQ ID NO: 108 - DNA, 20 bp, Artificial sequence
  Synthetic Oligonucleotide
ctgcatattagaatacatgg

SEQ ID NO: 109 - DNA, 20 bp, Artificial sequence
  Synthetic Oligonucleotide
cataatttgaaccaggcttt

SEQ ID NO: 110 - DNA, 16 bp, Artificial sequence
  Synthetic Oligonucleotide
aaatcttgattttggc

SEQ ID NO: 111 - DNA, 16 bp, Artificial sequence
  Synthetic Oligonucleotide
ttcttggtgctcttgg

SEQ ID NO: 112 - DNA, 16 bp, Artificial sequence
  Synthetic Oligonucleotide
cgtggaactgttttct

SEQ ID NO: 113 - DNA, 16 bp, Artificial sequence
  Synthetic Oligonucleotide
cttgatcaattctgga

SEQ ID NO: 114 - DNA, 16 bp, Artificial sequence
  Synthetic Oligonucleotide
gtcttgatcaattctg

SEQ ID NO: 115 - DNA, 16 bp, Artificial sequence
  Synthetic Oligonucleotide
tggctctggagataga

SEQ ID NO: 116 - DNA, 16 bp, Artificial sequence
  Synthetic Oligonucleotide
tgattttggctctgga

SEQ ID NO: 117 - DNA, 16 bp, Artificial sequence
  Synthetic Oligonucleotide
cttgattttggctctg

SEQ ID NO: 118 - DNA, 16 bp, Artificial sequence
  Synthetic Oligonucleotide
ggtgctcttggcttgg

SEQ ID NO: 119 - DNA, 16 bp, Artificial sequence
  Synthetic Oligonucleotide
atcttctctaggccca

SEQ ID NO: 120 - DNA, 16 bp, Artificial sequence
  Synthetic Oligonucleotide
gttgtctttccagtct

SEQ ID NO: 121 - DNA, 16 bp, Artificial sequence
  Synthetic Oligonucleotide
gtttgttgtctttcca

SEQ ID NO: 122 - DNA, 16 bp, Artificial sequence
  Synthetic Oligonucleotide
gtgatttcccaagtaa

SEQ ID NO: 123 - DNA, 16 bp, Artificial sequence
  Synthetic Oligonucleotide
tggatcaacattttgg

SEQ ID NO: 124 - DNA, 16 bp, Artificial sequence
  Synthetic Oligonucleotide
gaatctgttggatgga

SEQ ID NO: 125 - DNA, 16 bp, Artificial sequence
  Synthetic Oligonucleotide
ttctgaatctgttgga

SEQ ID NO: 126 - DNA, 16 bp, Artificial sequence
  Synthetic Oligonucleotide
gttcattcaaagcttt

SEQ ID NO: 127 - DNA, 16 bp, Artificial sequence
  Synthetic Oligonucleotide
cagttcattcaaagct

SEQ ID NO: 128 - DNA, 16 bp, Artificial sequence
  Synthetic Oligonucleotide
ttaacttggaatgagg

SEQ ID NO: 129 - DNA, 16 bp, Artificial sequence
  Synthetic Oligonucleotide
agaccacattaacttg

SEQ ID NO: 130 - DNA, 16 bp, Artificial sequence
  Synthetic Oligonucleotide
agattattagaccaca

SEQ ID NO: 131 - DNA, 16 bp, Artificial sequence
  Synthetic Oligonucleotide
ccagattattagacca

SEQ ID NO: 132 - DNA, 16 bp, Artificial sequence
  Synthetic Oligonucleotide
atctatttctcaagct

SEQ ID NO: 133 - DNA, 16 bp, Artificial sequence
  Synthetic Oligonucleotide
atagacagtgacttta

SEQ ID NO: 134 - DNA, 16 bp, Artificial sequence
  Synthetic Oligonucleotide
atactctgtgctgacg

SEQ ID NO: 135 - DNA, 16 bp, Artificial sequence
  Synthetic Oligonucleotide
actctgtgctgacgat

SEQ ID NO: 136 - DNA, 16 bp, Artificial sequence
  Synthetic Oligonucleotide
acatactctgtgctga

SEQ ID NO: 137 - DNA, 16 bp, Artificial sequence
  Synthetic Oligonucleotide
gtagcaaaatgaagca

SEQ ID NO: 138 - DNA, 16 bp, Artificial sequence
  Synthetic Oligonucleotide
tcaaacatttactcca

SEQ ID NO: 139 - DNA, 16 bp, Artificial sequence
  Synthetic Oligonucleotide
taaagacagcgaactt

SEQ ID NO: 140 - DNA, 16 bp, Artificial sequence
  Synthetic Oligonucleotide
tgtttaaagacagcga

SEQ ID NO: 141 - DNA, 16 bp, Artificial sequence
  Synthetic Oligonucleotide
agtagtcatctccatt

SEQ ID NO: 142 - DNA, 16 bp, Artificial sequence
  Synthetic Oligonucleotide
ttagtagtcatctcca

SEQ ID NO: 143 - DNA, 16 bp, Artificial sequence
  Synthetic Oligonucleotide
acaaaggtaggtcacc

SEQ ID NO: 144 - DNA, 16 bp, Artificial sequence
  Synthetic Oligonucleotide
tgacatgtatattgga

SEQ ID NO: 145 - DNA, 16 bp, Artificial sequence
  Synthetic Oligonucleotide
gtacttttctggaaca

SEQ ID NO: 146 - DNA, 16 bp, Artificial sequence
  Synthetic Oligonucleotide
cttggtctaaagagcc

SEQ ID NO: 147 - DNA, 16 bp, Artificial sequence
  Synthetic Oligonucleotide
tctgtagatgttggca

SEQ ID NO: 148 - DNA, 16 bp, Artificial sequence
  Synthetic Oligonucleotide
ataatttgaaccaggc

SEQ ID NO: 149 - DNA, 16 bp, Artificial sequence
  Synthetic Oligonucleotide
agcagacattggtcgg

SEQ ID NO: 150 - DNA, 16 bp, Artificial sequence
  Synthetic Oligonucleotide
cagattgtacagatta

SEQ ID NO: 151 - DNA, 16 bp, Artificial sequence
  Synthetic Oligonucleotide
gtagaggaatatttgc

SEQ ID NO: 152 - DNA, 16 bp, Artificial sequence
  Synthetic Oligonucleotide
aaagtctgattatcct

SEQ ID NO: 153 - DNA, 16 bp, Artificial sequence
  Synthetic Oligonucleotide
tagtcttgaatccctt

SEQ ID NO: 154 - DNA, 16 bp, Artificial sequence
  Synthetic Oligonucleotide
aagttgtcattgcaga

SEQ ID NO: 155 - DNA, 16 bp, Artificial sequence
  Synthetic Oligonucleotide
tctgtataagtcccaa

SEQ ID NO: 156 - DNA, 16 bp, Artificial sequence
  Synthetic Oligonucleotide
gatgcatgtatcccag

SEQ ID NO: 157 - DNA, 16 bp, Artificial sequence
  Synthetic Oligonucleotide
gtaagtttatcttcct

SEQ ID NO: 158 - DNA, 16 bp, Artificial sequence
  Synthetic Oligonucleotide
ctgttactgtatttcc

SEQ ID NO: 159 - DNA, 16 bp, Artificial sequence
  Synthetic Oligonucleotide
tgcagcgatagatcat

SEQ ID NO: 160 - DNA, 16 bp, Artificial sequence
  Synthetic Oligonucleotide
ctggtttgcagcgata

SEQ ID NO: 161 - DNA, 16 bp, Artificial sequence
  Synthetic Oligonucleotide
ctttgatttcactggt

SEQ ID NO: 162 - DNA, 16 bp, Artificial sequence
  Synthetic Oligonucleotide
gttcttctcagttcct

SEQ ID NO: 163 - DNA, 16 bp, Artificial sequence
  Synthetic Oligonucleotide
gttagttagttgctct

SEQ ID NO: 164 - DNA, 16 bp, Artificial sequence
  Synthetic Oligonucleotide
gtatgttcacctctgt

SEQ ID NO: 165 - DNA, 16 bp, Artificial sequence
  Synthetic Oligonucleotide
gagttgctgggtctga

SEQ ID NO: 166 - DNA, 16 bp, Artificial sequence
  Synthetic Oligonucleotide
aaacttgagagttgct

SEQ ID NO: 167 - DNA, 16 bp, Artificial sequence
  Synthetic Oligonucleotide
gtccatggactacctg

SEQ ID NO: 168 - DNA, 16 bp, Artificial sequence
  Synthetic Oligonucleotide
ccatctattcgatgtt

SEQ ID NO: 169 - DNA, 16 bp, Artificial sequence
  Synthetic Oligonucleotide
tagattttgctcttgg

SEQ ID NO: 170 - DNA, 16 bp, Artificial sequence
  Synthetic Oligonucleotide
ccattttgagacttcc

SEQ ID NO: 171 - DNA, 16 bp, Artificial sequence
  Synthetic Oligonucleotide
tagagtataaccttcc

SEQ ID NO: 172 - DNA, 16 bp, Artificial sequence
  Synthetic Oligonucleotide
ctcatcatgccaccac

SEQ ID NO: 173 - DNA, 16 bp, Artificial sequence
  Synthetic Oligonucleotide
cacactcatcatgcca

SEQ ID NO: 174 - DNA, 16 bp, Artificial sequence
  Synthetic Oligonucleotide
gagaaatgtaaacggt

SEQ ID NO: 175 - DNA, 16 bp, Artificial sequence
  Synthetic Oligonucleotide
ctcatatgatgccttt

SEQ ID NO: 176 - DNA, 16 bp, Artificial sequence
  Synthetic Oligonucleotide
agctcatatgatgcct

SEQ ID NO: 177 - DNA, 16 bp, Artificial sequence
  Synthetic Oligonucleotide
ttagctcatatgatgc

SEQ ID NO: 178 - DNA, 16 bp, Artificial sequence
  Synthetic Oligonucleotide
ttgtgatattagctca

SEQ ID NO: 179 - DNA, 16 bp, Artificial sequence
  Synthetic Oligonucleotide
actgggaaagttgtga

SEQ ID NO: 180 - DNA, 16 bp, Artificial sequence
  Synthetic Oligonucleotide
aatctgacaagattcc

SEQ ID NO: 181 - DNA, 16 bp, Artificial sequence
  Synthetic Oligonucleotide
ctcgatgccacaaata

SEQ ID NO: 182 - DNA, 16 bp, Artificial sequence
  Synthetic Oligonucleotide
taactcgatgccacaa

SEQ ID NO: 183 - DNA, 16 bp, Artificial sequence
  Synthetic Oligonucleotide
tgcttgtcaggctgtt

SEQ ID NO: 184 - DNA, 16 bp, Artificial sequence
  Synthetic Oligonucleotide
acatgcttgtcaggct

SEQ ID NO: 185 - DNA, 16 bp, Artificial sequence
  Synthetic Oligonucleotide
cagttatgctgatgtg

SEQ ID NO: 186 - DNA, 16 bp, Artificial sequence
  Synthetic Oligonucleotide
aagttttagagccatg

SEQ ID NO: 187 - DNA, 16 bp, Artificial sequence
  Synthetic Oligonucleotide
ctgtcacttcaccaga

SEQ ID NO: 188 - DNA, 16 bp, Artificial sequence
  Synthetic Oligonucleotide
tggattctgacatagc

SEQ ID NO: 189 - DNA, 16 bp, Artificial sequence
  Synthetic Oligonucleotide
aaccttttagcagcac

SEQ ID NO: 190 - DNA, 16 bp, Artificial sequence
  Synthetic Oligonucleotide
ttgcttgctgggtatt

SEQ ID NO: 191 - DNA, 16 bp, Artificial sequence
  Synthetic Oligonucleotide
gtcttttatagggtgt

SEQ ID NO: 192 - DNA, 16 bp, Artificial sequence
  Synthetic Oligonucleotide
ttgtcttaggtatgtc

SEQ ID NO: 193 - DNA, 16 bp, Artificial sequence
  Synthetic Oligonucleotide
ctctgattgtcttagg

SEQ ID NO: 194 - DNA, 16 bp, Artificial sequence
  Synthetic Oligonucleotide
gtatttctctgattgt

SEQ ID NO: 195 - DNA, 16 bp, Artificial sequence
  Synthetic Oligonucleotide
tttttcttagatggcg

SEQ ID NO: 196 - DNA, 16 bp, Artificial sequence
  Synthetic Oligonucleotide
gggctttcactggtag

SEQ ID NO: 197 - DNA, 16 bp, Artificial sequence
  Synthetic Oligonucleotide
acagtcaagagatgtg

SEQ ID NO: 198 - DNA, 20 bp, Artificial sequence
  Synthetic Oligonucleotide
atcttgattttggctctgga

SEQ ID NO: 199 - DNA, 20 bp, Artificial sequence
  Synthetic Oligonucleotide
gttcttggtgctcttggctt

SEQ ID NO: 200 - DNA, 20 bp, Artificial sequence
  Synthetic Oligonucleotide
tagttcttggtgctcttggc

SEQ ID NO: 201 - DNA, 20 bp, Artificial sequence
  Synthetic Oligonucleotide
aggttgttttctccacactc

SEQ ID NO: 202 - DNA, 20 bp, Artificial sequence
  Synthetic Oligonucleotide
acacatactctgtgctgacg

SEQ ID NO: 203 - DNA, 20 bp, Artificial sequence
  Synthetic Oligonucleotide
gtggcaaatgtagcattttt

SEQ ID NO: 204 - DNA, 20 bp, Artificial sequence
  Synthetic Oligonucleotide
gccacaaatatgttcattct

SEQ ID NO: 205 - DNA, 17 bp, Artificial sequence
  Synthetic Oligonucleotide
tcttggtgctcttggct

SEQ ID NO: 206 - DNA, 17 bp, Artificial sequence
  Synthetic Oligonucleotide
ccagattattagaccac

SEQ ID NO: 207 - DNA, 17 bp, Artificial sequence
  Synthetic Oligonucleotide
gctcatatgatgccttt

SEQ ID NO: 208 - DNA, 17 bp, Artificial sequence
  Synthetic Oligonucleotide
gcttgtcaggctgttta

SEQ ID NO: 209 - DNA, 16 bp, Artificial sequence
  Synthetic Oligonucleotide
tgtcttgatcaattct

SEQ ID NO: 210 - DNA, 16 bp, Artificial sequence
  Synthetic Oligonucleotide
ttgattttggctctgg

SEQ ID NO: 211 - DNA, 16 bp, Artificial sequence
  Synthetic Oligonucleotide
actggtttgcagcgat

SEQ ID NO: 212 - DNA, 16 bp, Artificial sequence
  Synthetic Oligonucleotide
agattttgctcttggt

SEQ ID NO: 213 - DNA, 16 bp, Artificial sequence
  Synthetic Oligonucleotide
cattttgagacttcca

SEQ ID NO: 214 - DNA, 16 bp, Artificial sequence
  Synthetic Oligonucleotide
tccattttgagacttc

SEQ ID NO: 215 - DNA, 16 bp, Artificial sequence
  Synthetic Oligonucleotide
accagattattagacc

SEQ ID NO: 216 - DNA, 16 bp, Artificial sequence
  Synthetic Oligonucleotide
tagacagtgactttaa

SEQ ID NO: 217 - DNA, 16 bp, Artificial sequence
  Synthetic Oligonucleotide
tgagaaatgtaaacgg

SEQ ID NO: 218 - DNA, 16 bp, Artificial sequence
  Synthetic Oligonucleotide
gctcatatgatgcctt

SEQ ID NO: 219 - DNA, 16 bp, Artificial sequence
  Synthetic Oligonucleotide
cttagtagtcatctcc

SEQ ID NO: 220 - DNA, 16 bp, Artificial sequence
  Synthetic Oligonucleotide
agagtataaccttcca

SEQ ID NO: 221 - DNA, 16 bp, Artificial sequence
  Synthetic Oligonucleotide
cagattattagaccac

SEQ ID NO: 222 - DNA, 16 bp, Artificial sequence
  Synthetic Oligonucleotide
tagctcatatgatgcc

SEQ ID NO: 223 - DNA, 16 bp, Artificial sequence
  Synthetic Oligonucleotide
ccttttagcagcacta

SEQ ID NO: 224 - DNA, 16 bp, Artificial sequence
  Synthetic Oligonucleotide
accttttagcagcact

SEQ ID NO: 225 - DNA, 16 bp, Artificial sequence
  Synthetic Oligonucleotide
aaaccttttagcagca

SEQ ID NO: 226 - DNA, 16 bp, Artificial sequence
  Synthetic Oligonucleotide
atctgtagatgttggc

SEQ ID NO: 227 - DNA, 16 bp, Artificial sequence
  Synthetic Oligonucleotide
taatttgaaccaggct

SEQ ID NO: 228 - DNA, 16 bp, Artificial sequence
  Synthetic Oligonucleotide
ttttcttagatggcgt

SEQ ID NO: 229 - DNA, 16 bp, Artificial sequence
  Synthetic Oligonucleotide
atctgtataagtccca

SEQ ID NO: 230 - DNA, 16 bp, Artificial sequence
  Synthetic Oligonucleotide
aatctgtataagtccc

SEQ ID NO: 231 - DNA, 16 bp, Artificial sequence
  Synthetic Oligonucleotide
atgcatgtatcccagt

SEQ ID NO: 232 - DNA, 16 bp, Artificial sequence
  Synthetic Oligonucleotide
tagatgcatgtatccc

SEQ ID NO: 233 - DNA, 20 bp, Artificial sequence
  Synthetic Oligonucleotide
agtagttcttggtgctcttg

SEQ ID NO: 234 - DNA, 20 bp, Artificial sequence
  Synthetic Oligonucleotide
ggttcttgaatactagtcct

SEQ ID NO: 235 - DNA, 20 bp, Artificial sequence
  Synthetic Oligonucleotide
aaatttctgtgggttcttga

SEQ ID NO: 236 - DNA, 20 bp, Artificial sequence
  Synthetic Oligonucleotide
tggcttggaagatagagaaa

SEQ ID NO: 237 - DNA, 20 bp, Artificial sequence
  Synthetic Oligonucleotide
gtattagaatcacagcatat

SEQ ID NO: 238 - DNA, 20 bp, Artificial sequence
  Synthetic Oligonucleotide
gattttcaatttcaagcaac

SEQ ID NO: 239 - DNA, 20 bp, Artificial sequence
  Synthetic Oligonucleotide
agcttaattgtgaacatttt

SEQ ID NO: 240 - DNA, 20 bp, Artificial sequence
  Synthetic Oligonucleotide
gaaggagcttaattgtgaac

SEQ ID NO: 241 - DNA, 20 bp, Artificial sequence
  Synthetic Oligonucleotide
caataaaaagaaggagctta

SEQ ID NO: 242 - DNA, 20 bp, Artificial sequence
  Synthetic Oligonucleotide
gaacaataaaaagaaggagc

SEQ ID NO: 243 - DNA, 20 bp, Artificial sequence
  Synthetic Oligonucleotide
ctggaggaaataactagagg

SEQ ID NO: 244 - DNA, 20 bp, Artificial sequence
  Synthetic Oligonucleotide
attctggaggaaataactag

SEQ ID NO: 245 - DNA, 20 bp, Artificial sequence
  Synthetic Oligonucleotide
tcaaatgatgaattgtcttg

SEQ ID NO: 246 - DNA, 20 bp, Artificial sequence
  Synthetic Oligonucleotide
ttgattttggctctggagat

SEQ ID NO: 247 - DNA, 20 bp, Artificial sequence
  Synthetic Oligonucleotide
gcaaatcttgattttggctc

SEQ ID NO: 248 - DNA, 20 bp, Artificial sequence
  Synthetic Oligonucleotide
atagcaaatcttgattttgg

SEQ ID NO: 249 - DNA, 20 bp, Artificial sequence
  Synthetic Oligonucleotide
cgtctaacatagcaaatctt

SEQ ID NO: 250 - DNA, 20 bp, Artificial sequence
  Synthetic Oligonucleotide
tggctaaaatttttacatcg

SEQ ID NO: 251 - DNA, 20 bp, Artificial sequence
  Synthetic Oligonucleotide
ccattggctaaaatttttac

SEQ ID NO: 252 - DNA, 20 bp, Artificial sequence
  Synthetic Oligonucleotide
aggaggccattggctaaaat

SEQ ID NO: 253 - DNA, 20 bp, Artificial sequence
  Synthetic Oligonucleotide
tgaaggaggccattggctaa

SEQ ID NO: 254 - DNA, 20 bp, Artificial sequence
  Synthetic Oligonucleotide
gtcccaactgaaggaggcca

SEQ ID NO: 255 - DNA, 20 bp, Artificial sequence
  Synthetic Oligonucleotide
ccatgtcccaactgaaggag

SEQ ID NO: 256 - DNA, 20 bp, Artificial sequence
  Synthetic Oligonucleotide
agaccatgtcccaactgaag

SEQ ID NO: 257 - DNA, 20 bp, Artificial sequence
  Synthetic Oligonucleotide
tttaagaccatgtcccaact

SEQ ID NO: 258 - DNA, 20 bp, Artificial sequence
  Synthetic Oligonucleotide
gtctttaagaccatgtccca

SEQ ID NO: 259 - DNA, 20 bp, Artificial sequence
  Synthetic Oligonucleotide
ggacaaagtctttaagacca

SEQ ID NO: 260 - DNA, 20 bp, Artificial sequence
  Synthetic Oligonucleotide
tcttatggacaaagtcttta

SEQ ID NO: 261 - DNA, 20 bp, Artificial sequence
  Synthetic Oligonucleotide
tatgtcattaatttggccct

SEQ ID NO: 262 - DNA, 20 bp, Artificial sequence
  Synthetic Oligonucleotide
gatcaaatatgttgagtttt

SEQ ID NO: 263 - DNA, 20 bp, Artificial sequence
  Synthetic Oligonucleotide
gactgatcaaatatgttgag

SEQ ID NO: 264 - DNA, 20 bp, Artificial sequence
  Synthetic Oligonucleotide
tcttctttgatttcactggt

SEQ ID NO: 265 - DNA, 20 bp, Artificial sequence
  Synthetic Oligonucleotide
cttctcagttccttttcttc

SEQ ID NO: 266 - DNA, 20 bp, Artificial sequence
  Synthetic Oligonucleotide
gttcttctcagttccttttc

SEQ ID NO: 267 - DNA, 20 bp, Artificial sequence
  Synthetic Oligonucleotide
tgtagttcttctcagttcct

SEQ ID NO: 268 - DNA, 20 bp, Artificial sequence
  Synthetic Oligonucleotide
tatatgtagttcttctcagt

SEQ ID NO: 269 - DNA, 20 bp, Artificial sequence
  Synthetic Oligonucleotide
gtttatatgtagttcttctc

SEQ ID NO: 270 - DNA, 20 bp, Artificial sequence
  Synthetic Oligonucleotide
tgtagtttatatgtagttct

SEQ ID NO: 271 - DNA, 20 bp, Artificial sequence
  Synthetic Oligonucleotide
gacttgtagtttatatgtag

SEQ ID NO: 272 - DNA, 20 bp, Artificial sequence
  Synthetic Oligonucleotide
tcatttttgacttgtagttt

SEQ ID NO: 273 - DNA, 20 bp, Artificial sequence
  Synthetic Oligonucleotide
cctcttcatttttgacttgt

SEQ ID NO: 274 - DNA, 20 bp, Artificial sequence
  Synthetic Oligonucleotide
tctttacctcttcatttttg

SEQ ID NO: 275 - DNA, 20 bp, Artificial sequence
  Synthetic Oligonucleotide
catattctttacctcttcat

SEQ ID NO: 276 - DNA, 20 bp, Artificial sequence
  Synthetic Oligonucleotide
gtgacatattctttacctct

SEQ ID NO: 277 - DNA, 20 bp, Artificial sequence
  Synthetic Oligonucleotide
gagttcaagtgacatattct

SEQ ID NO: 278 - DNA, 20 bp, Artificial sequence
  Synthetic Oligonucleotide
tgagttgagttcaagtgaca

SEQ ID NO: 279 - DNA, 20 bp, Artificial sequence
  Synthetic Oligonucleotide
agttttgagttgagttcaag

SEQ ID NO: 280 - DNA, 20 bp, Artificial sequence
  Synthetic Oligonucleotide
tcaagttttgagttgagttc

SEQ ID NO: 281 - DNA, 20 bp, Artificial sequence
  Synthetic Oligonucleotide
ggaggctttcaagttttgag

SEQ ID NO: 282 - DNA, 20 bp, Artificial sequence
  Synthetic Oligonucleotide
tttcttctaggaggctttca

SEQ ID NO: 283 - DNA, 20 bp, Artificial sequence
  Synthetic Oligonucleotide
attttttcttctaggaggct

SEQ ID NO: 284 - DNA, 20 bp, Artificial sequence
  Synthetic Oligonucleotide
gtagaattttttcttctagg

SEQ ID NO: 285 - DNA, 20 bp, Artificial sequence
  Synthetic Oligonucleotide
gctcttctaaatatttcact

SEQ ID NO: 286 - DNA, 20 bp, Artificial sequence
  Synthetic Oligonucleotide
agttagttagttgctcttct

SEQ ID NO: 287 - DNA, 20 bp, Artificial sequence
  Synthetic Oligonucleotide
caggttgattttgaattaag

SEQ ID NO: 288 - DNA, 20 bp, Artificial sequence
  Synthetic Oligonucleotide
tttcaggttgattttgaatt

SEQ ID NO: 289 - DNA, 20 bp, Artificial sequence
  Synthetic Oligonucleotide
ggagtttcaggttgattttg

SEQ ID NO: 290 - DNA, 20 bp, Artificial sequence
  Synthetic Oligonucleotide
gttctggagtttcaggttga

SEQ ID NO: 291 - DNA, 20 bp, Artificial sequence
  Synthetic Oligonucleotide
ttaagtgaagttacttctgg

SEQ ID NO: 292 - DNA, 20 bp, Artificial sequence
  Synthetic Oligonucleotide
tgctattatcttgtttttct

SEQ ID NO: 293 - DNA, 20 bp, Artificial sequence
  Synthetic Oligonucleotide
ggtctttgatgctattatct

SEQ ID NO: 294 - DNA, 20 bp, Artificial sequence
  Synthetic Oligonucleotide
gaaggtctttgatgctatta

SEQ ID NO: 295 - DNA, 20 bp, Artificial sequence
  Synthetic Oligonucleotide
ctggagaaggtctttgatgc

SEQ ID NO: 296 - DNA, 20 bp, Artificial sequence
  Synthetic Oligonucleotide
ctgagctgattttctatttc

SEQ ID NO: 297 - DNA, 20 bp, Artificial sequence
  Synthetic Oligonucleotide
atttctgtgggttcttgaat

SEQ ID NO: 298 - DNA, 20 bp, Artificial sequence
  Synthetic Oligonucleotide
gagaaatttctgtgggttct

SEQ ID NO: 299 - DNA, 20 bp, Artificial sequence
  Synthetic Oligonucleotide
gatagagaaatttctgtggg

SEQ ID NO: 300 - DNA, 20 bp, Artificial sequence
  Synthetic Oligonucleotide
cttggaagatagagaaattt

SEQ ID NO: 301 - DNA, 20 bp, Artificial sequence
  Synthetic Oligonucleotide
gtgctcttggcttggaagat

SEQ ID NO: 302 - DNA, 20 bp, Artificial sequence
  Synthetic Oligonucleotide
cttggtgctcttggcttgga

SEQ ID NO: 303 - DNA, 20 bp, Artificial sequence
  Synthetic Oligonucleotide
gggagtagttcttggtgctc

SEQ ID NO: 304 - DNA, 20 bp, Artificial sequence
  Synthetic Oligonucleotide
ctgaagaaagggagtagttc

SEQ ID NO: 305 - DNA, 20 bp, Artificial sequence
  Synthetic Oligonucleotide
atcatgttttacatttctta

SEQ ID NO: 306 - DNA, 20 bp, Artificial sequence
  Synthetic Oligonucleotide
gccatcatgttttacatttc

SEQ ID NO: 307 - DNA, 20 bp, Artificial sequence
  Synthetic Oligonucleotide
gaatgccatcatgttttaca

SEQ ID NO: 308 - DNA, 20 bp, Artificial sequence
  Synthetic Oligonucleotide
caggaatgccatcatgtttt

SEQ ID NO: 309 - DNA, 20 bp, Artificial sequence
  Synthetic Oligonucleotide
gacttcttaactctatatat

SEQ ID NO: 310 - DNA, 20 bp, Artificial sequence
  Synthetic Oligonucleotide
ctagacttcttaactctata

SEQ ID NO: 311 - DNA, 20 bp, Artificial sequence
  Synthetic Oligonucleotide
gacctagacttcttaactct

SEQ ID NO: 312 - DNA, 20 bp, Artificial sequence
  Synthetic Oligonucleotide
ggaagcagacctagacttct

SEQ ID NO: 313 - DNA, 20 bp, Artificial sequence
  Synthetic Oligonucleotide
tctggaagcagacctagact

SEQ ID NO: 314 - DNA, 20 bp, Artificial sequence
  Synthetic Oligonucleotide
tcttctggaagcagacctag

SEQ ID NO: 315 - DNA, 20 bp, Artificial sequence
  Synthetic Oligonucleotide
ctaatctttagggatttagg

SEQ ID NO: 316 - DNA, 20 bp, Artificial sequence
  Synthetic Oligonucleotide
tgtatctaatctttagggat

SEQ ID NO: 317 - DNA, 20 bp, Artificial sequence
  Synthetic Oligonucleotide
taacttgggcactatatcct

SEQ ID NO: 318 - DNA, 20 bp, Artificial sequence
  Synthetic Oligonucleotide
attgacaaaggtaggtcacc

SEQ ID NO: 319 - DNA, 20 bp, Artificial sequence
  Synthetic Oligonucleotide
atatgacatgtatattggat

SEQ ID NO: 320 - DNA, 20 bp, Artificial sequence
  Synthetic Oligonucleotide
ttttgtacttttctggaaca

SEQ ID NO: 321 - DNA, 20 bp, Artificial sequence
  Synthetic Oligonucleotide
tagtctgtggtcctgaaaat

SEQ ID NO: 322 - DNA, 20 bp, Artificial sequence
  Synthetic Oligonucleotide
agcttagtctgtggtcctga

SEQ ID NO: 323 - DNA, 20 bp, Artificial sequence
  Synthetic Oligonucleotide
gacagcttagtctgtggtcc

SEQ ID NO: 324 - DNA, 20 bp, Artificial sequence
  Synthetic Oligonucleotide
gtattctggccctaaaaaaa

SEQ ID NO: 325 - DNA, 20 bp, Artificial sequence
  Synthetic Oligonucleotide
attttggtattctggcccta

SEQ ID NO: 326 - DNA, 20 bp, Artificial sequence
  Synthetic Oligonucleotide
tttgcatttgaaattgtcca

SEQ ID NO: 327 - DNA, 20 bp, Artificial sequence
  Synthetic Oligonucleotide
ggaagcaactcatatattaa

SEQ ID NO: 328 - DNA, 20 bp, Artificial sequence
  Synthetic Oligonucleotide
tatcagaaaaagatacctga

SEQ ID NO: 329 - DNA, 20 bp, Artificial sequence
  Synthetic Oligonucleotide
ataatagctaataatgtggg

SEQ ID NO: 330 - DNA, 20 bp, Artificial sequence
  Synthetic Oligonucleotide
tgcagataatagctaataat

SEQ ID NO: 331 - DNA, 20 bp, Artificial sequence
  Synthetic Oligonucleotide
tgtcattgcagataatagct

SEQ ID NO: 332 - DNA, 20 bp, Artificial sequence
  Synthetic Oligonucleotide
taaaagttgtcattgcagat

SEQ ID NO: 333 - DNA, 20 bp, Artificial sequence
  Synthetic Oligonucleotide
cggatttttaaaagttgtca

SEQ ID NO: 334 - DNA, 20 bp, Artificial sequence
  Synthetic Oligonucleotide
gggattcggatttttaaaag

SEQ ID NO: 335 - DNA, 20 bp, Artificial sequence
  Synthetic Oligonucleotide
tttgggattcggatttttaa

SEQ ID NO: 336 - DNA, 20 bp, Artificial sequence
  Synthetic Oligonucleotide
acgcttatttgggattcgga

SEQ ID NO: 337 - DNA, 20 bp, Artificial sequence
  Synthetic Oligonucleotide
tttaagagatttacaagtca

SEQ ID NO: 338 - DNA, 20 bp, Artificial sequence
  Synthetic Oligonucleotide
gactacctgtttttaaaagc

SEQ ID NO: 339 - DNA, 20 bp, Artificial sequence
  Synthetic Oligonucleotide
tatggtgactacctgttttt

SEQ ID NO: 340 - DNA, 20 bp, Artificial sequence
  Synthetic Oligonucleotide
actttgctgtattataaact

SEQ ID NO: 341 - DNA, 20 bp, Artificial sequence
  Synthetic Oligonucleotide
attgtatttaactttgctgt

SEQ ID NO: 342 - DNA, 20 bp, Artificial sequence
  Synthetic Oligonucleotide
gagcaactaacttaataggt

SEQ ID NO: 343 - DNA, 20 bp, Artificial sequence
  Synthetic Oligonucleotide
gaaatgagcaactaacttaa

SEQ ID NO: 344 - DNA, 20 bp, Artificial sequence
  Synthetic Oligonucleotide
aatcaaagaaatgagcaact

SEQ ID NO: 345 - DNA, 20 bp, Artificial sequence
  Synthetic Oligonucleotide
accttcttccacattgagtt

SEQ ID NO: 346 - DNA, 20 bp, Artificial sequence
  Synthetic Oligonucleotide
cacgaatgtaaccttcttcc

SEQ ID NO: 347 - DNA, 20 bp, Artificial sequence
  Synthetic Oligonucleotide
ttaacttgcacgaatgtaac

SEQ ID NO: 348 - DNA, 20 bp, Artificial sequence
  Synthetic Oligonucleotide
tatatataccaatatttgcc

SEQ ID NO: 349 - DNA, 20 bp, Artificial sequence
  Synthetic Oligonucleotide
tcttaactctatatatacca

SEQ ID NO: 350 - DNA, 20 bp, Artificial sequence
  Synthetic Oligonucleotide
ctttaagtgaagttacttct

SEQ ID NO: 351 - DNA, 20 bp, Artificial sequence
  Synthetic Oligonucleotide
tctacttactttaagtgaag

SEQ ID NO: 352 - DNA, 20 bp, Artificial sequence
  Synthetic Oligonucleotide
gaaccctctttattttctac

SEQ ID NO: 353 - DNA, 20 bp, Artificial sequence
  Synthetic Oligonucleotide
acataaacatgaaccctctt

SEQ ID NO: 354 - DNA, 20 bp, Artificial sequence
  Synthetic Oligonucleotide
ccacattgaaaacataaaca

SEQ ID NO: 355 - DNA, 20 bp, Artificial sequence
  Synthetic Oligonucleotide
gcatgccttagaaatatttt

SEQ ID NO: 356 - DNA, 20 bp, Artificial sequence
  Synthetic Oligonucleotide
caatgcaacaaagtatttca

SEQ ID NO: 357 - DNA, 20 bp, Artificial sequence
  Synthetic Oligonucleotide
ctggagattatttttcttgg

SEQ ID NO: 358 - DNA, 20 bp, Artificial sequence
  Synthetic Oligonucleotide
ttcatatataacattaggga

SEQ ID NO: 359 - DNA, 20 bp, Artificial sequence
  Synthetic Oligonucleotide
tcagtgttttcatatataac

SEQ ID NO: 360 - DNA, 20 bp, Artificial sequence
  Synthetic Oligonucleotide
gacatagtgttctagattgt

SEQ ID NO: 361 - DNA, 20 bp, Artificial sequence
  Synthetic Oligonucleotide
caatagtgtaatgacatagt

SEQ ID NO: 362 - DNA, 20 bp, Artificial sequence
  Synthetic Oligonucleotide
ttacttaccttcagtaattt

SEQ ID NO: 363 - DNA, 20 bp, Artificial sequence
  Synthetic Oligonucleotide
atcttttccatttactgtat

SEQ ID NO: 364 - DNA, 20 bp, Artificial sequence
  Synthetic Oligonucleotide
agaaaaagcccagcatattt

SEQ ID NO: 365 - DNA, 20 bp, Artificial sequence
  Synthetic Oligonucleotide
gtatgcttctttcaaatagc

SEQ ID NO: 366 - DNA, 20 bp, Artificial sequence
  Synthetic Oligonucleotide
ccttccccttgtatgcttct

SEQ ID NO: 367 - DNA, 20 bp, Artificial sequence
  Synthetic Oligonucleotide
cctgtaacactatcataatc

SEQ ID NO: 368 - DNA, 20 bp, Artificial sequence
  Synthetic Oligonucleotide
tgacttacctgattttctat

SEQ ID NO: 369 - DNA, 20 bp, Artificial sequence
  Synthetic Oligonucleotide
gatgggacataccattaaaa

SEQ ID NO: 370 - DNA, 20 bp, Artificial sequence
  Synthetic Oligonucleotide
gtgaaagatgggacatacca

SEQ ID NO: 371 - DNA, 20 bp, Artificial sequence
  Synthetic Oligonucleotide
cctgtgtgaaagatgggaca

SEQ ID NO: 372 - DNA, 20 bp, Artificial sequence
  Synthetic Oligonucleotide
cattggctgctatgaattaa

SEQ ID NO: 373 - DNA, 20 bp, Artificial sequence
  Synthetic Oligonucleotide
gatgacattggctgctatga

SEQ ID NO: 374 - DNA, 20 bp, Artificial sequence
  Synthetic Oligonucleotide
gagaaacatgatctaatttg

SEQ ID NO: 375 - DNA, 20 bp, Artificial sequence
  Synthetic Oligonucleotide
atggaaagctattgtgtggt

SEQ ID NO: 376 - DNA, 20 bp, Artificial sequence
  Synthetic Oligonucleotide
gtctaaagagccaatatgag

SEQ ID NO: 377 - DNA, 20 bp, Artificial sequence
  Synthetic Oligonucleotide
aatcttggtctaaagagcca

SEQ ID NO: 378 - DNA, 20 bp, Artificial sequence
  Synthetic Oligonucleotide
gagatttacaagtcaaaaat

SEQ ID NO: 379 - DNA, 20 bp, Artificial sequence
  Synthetic Oligonucleotide
atttaactttgctgtattat

SEQ ID NO: 380 - DNA, 20 bp, Artificial sequence
  Synthetic Oligonucleotide
atcaatgctaaatgaaatca

SEQ ID NO: 381 - DNA, 20 bp, Artificial sequence
  Synthetic Oligonucleotide
tattttctggagattatttt

SEQ ID NO: 382 - DNA, 20 bp, Artificial sequence
  Synthetic Oligonucleotide
aaaatgaatattggcaattc

SEQ ID NO: 383 - DNA, 20 bp, Artificial sequence
  Synthetic Oligonucleotide
aaagtcaatgtgacttagta

SEQ ID NO: 384 - DNA, 20 bp, Artificial sequence
  Synthetic Oligonucleotide
aaggtatagtgatacctcat

SEQ ID NO: 385 - DNA, 20 bp, Artificial sequence
  Synthetic Oligonucleotide
cagcaggaatgccatcatgt

SEQ ID NO: 386 - DNA, 20 bp, Artificial sequence
  Synthetic Oligonucleotide
tgatggcatacatgccactt

SEQ ID NO: 387 - DNA, 20 bp, Artificial sequence
  Synthetic Oligonucleotide
tgctgggtctgatggcatac

SEQ ID NO: 388 - DNA, 20 bp, Artificial sequence
  Synthetic Oligonucleotide
gagttgctgggtctgatggc

SEQ ID NO: 389 - DNA, 20 bp, Artificial sequence
  Synthetic Oligonucleotide
aaaacttgagagttgctggg

SEQ ID NO: 390 - DNA, 20 bp, Artificial sequence
  Synthetic Oligonucleotide
gacatgaaaaacttgagagt

SEQ ID NO: 391 - DNA, 20 bp, Artificial sequence
  Synthetic Oligonucleotide
acatcacagtagacatgaaa

SEQ ID NO: 392 - DNA, 20 bp, Artificial sequence
  Synthetic Oligonucleotide
agttttgtgatccatctatt

SEQ ID NO: 393 - DNA, 20 bp, Artificial sequence
  Synthetic Oligonucleotide
tgaagttttgtgatccatct

SEQ ID NO: 394 - DNA, 20 bp, Artificial sequence
  Synthetic Oligonucleotide
cgtttcattgaagttttgtg

SEQ ID NO: 395 - DNA, 20 bp, Artificial sequence
  Synthetic Oligonucleotide
ccatatttgtagttctccca

SEQ ID NO: 396 - DNA, 20 bp, Artificial sequence
  Synthetic Oligonucleotide
aaaccatatttgtagttctc

SEQ ID NO: 397 - DNA, 20 bp, Artificial sequence
  Synthetic Oligonucleotide
aattctccatcaagcctccc

SEQ ID NO: 398 - DNA, 20 bp, Artificial sequence
  Synthetic Oligonucleotide
atcttctctaggcccaacca

SEQ ID NO: 399 - DNA, 20 bp, Artificial sequence
  Synthetic Oligonucleotide
gagtatatcttctctaggcc

SEQ ID NO: 400 - DNA, 20 bp, Artificial sequence
  Synthetic Oligonucleotide
ctatggagtatatcttctct

SEQ ID NO: 401 - DNA, 20 bp, Artificial sequence
  Synthetic Oligonucleotide
gcttcactatggagtatatc

SEQ ID NO: 402 - DNA, 20 bp, Artificial sequence
  Synthetic Oligonucleotide
agattgcttcactatggagt

SEQ ID NO: 403 - DNA, 20 bp, Artificial sequence
  Synthetic Oligonucleotide
ccagtcttccaactcaattc

SEQ ID NO: 404 - DNA, 20 bp, Artificial sequence
  Synthetic Oligonucleotide
gtctttccagtcttccaact

SEQ ID NO: 405 - DNA, 20 bp, Artificial sequence
  Synthetic Oligonucleotide
gtttgttgtctttccagtct

SEQ ID NO: 406 - DNA, 20 bp, Artificial sequence
  Synthetic Oligonucleotide
aatgtttgttgtctttccag

SEQ ID NO: 407 - DNA, 20 bp, Artificial sequence
  Synthetic Oligonucleotide
cgtgatttcccaagtaaaaa

SEQ ID NO: 408 - DNA, 20 bp, Artificial sequence
  Synthetic Oligonucleotide
gttttccgggattgcattgg

SEQ ID NO: 409 - DNA, 20 bp, Artificial sequence
  Synthetic Oligonucleotide
tctttgttttccgggattgc

SEQ ID NO: 410 - DNA, 20 bp, Artificial sequence
  Synthetic Oligonucleotide
ccaaatctttgttttccggg

SEQ ID NO: 411 - DNA, 20 bp, Artificial sequence
  Synthetic Oligonucleotide
acaccaaatctttgttttcc

SEQ ID NO: 412 - DNA, 20 bp, Artificial sequence
  Synthetic Oligonucleotide
agaaaacaccaaatctttgt

SEQ ID NO: 413 - DNA, 20 bp, Artificial sequence
  Synthetic Oligonucleotide
caagtagaaaacaccaaatc

SEQ ID NO: 414 - DNA, 20 bp, Artificial sequence
  Synthetic Oligonucleotide
gatcccaagtagaaaacacc

SEQ ID NO: 415 - DNA, 20 bp, Artificial sequence
  Synthetic Oligonucleotide
tttgctttgtgatcccaagt

SEQ ID NO: 416 - DNA, 20 bp, Artificial sequence
  Synthetic Oligonucleotide
tccttttgctttgtgatccc

SEQ ID NO: 417 - DNA, 20 bp, Artificial sequence
  Synthetic Oligonucleotide
gaagtgtccttttgctttgt

SEQ ID NO: 418 - DNA, 20 bp, Artificial sequence
  Synthetic Oligonucleotide
tgccaccaccagcctcctga

SEQ ID NO: 419 - DNA, 20 bp, Artificial sequence
  Synthetic Oligonucleotide
ctcatcatgccaccaccagc

SEQ ID NO: 420 - DNA, 20 bp, Artificial sequence
  Synthetic Oligonucleotide
ccatttaggttgttttctcc

SEQ ID NO: 421 - DNA, 20 bp, Artificial sequence
  Synthetic Oligonucleotide
atatttaccatttaggttgt

SEQ ID NO: 422 - DNA, 20 bp, Artificial sequence
  Synthetic Oligonucleotide
cttggtttgttatatttacc

SEQ ID NO: 423 - DNA, 20 bp, Artificial sequence
  Synthetic Oligonucleotide
atagagtataaccttccatt

SEQ ID NO: 424 - DNA, 20 bp, Artificial sequence
  Synthetic Oligonucleotide
ttttatagagtataaccttc

SEQ ID NO: 425 - DNA, 20 bp, Artificial sequence
  Synthetic Oligonucleotide
tggttgattttatagagtat

SEQ ID NO: 426 - DNA, 20 bp, Artificial sequence
  Synthetic Oligonucleotide
attttggttgattttataga

SEQ ID NO: 427 - DNA, 20 bp, Artificial sequence
  Synthetic Oligonucleotide
tcaacattttggttgatttt

SEQ ID NO: 428 - DNA, 20 bp, Artificial sequence
  Synthetic Oligonucleotide
ggatggatcaacattttggt

SEQ ID NO: 429 - DNA, 20 bp, Artificial sequence
  Synthetic Oligonucleotide
gttggatggatcaacatttt

SEQ ID NO: 430 - DNA, 20 bp, Artificial sequence
  Synthetic Oligonucleotide
tctgttggatggatcaacat

SEQ ID NO: 431 - DNA, 20 bp, Artificial sequence
  Synthetic Oligonucleotide
ctgaatctgttggatggatc

SEQ ID NO: 432 - DNA, 20 bp, Artificial sequence
  Synthetic Oligonucleotide
agctttctgaatctgttgga

SEQ ID NO: 433 - DNA, 20 bp, Artificial sequence
  Synthetic Oligonucleotide
cattcaaagctttctgaatc

SEQ ID NO: 434 - DNA, 20 bp, Artificial sequence
  Synthetic Oligonucleotide
gttcattcaaagctttctga

SEQ ID NO: 435 - DNA, 20 bp, Artificial sequence
  Synthetic Oligonucleotide
tcagttcattcaaagctttc

SEQ ID NO: 436 - DNA, 20 bp, Artificial sequence
  Synthetic Oligonucleotide
gcctcagttcattcaaagct

SEQ ID NO: 437 - DNA, 20 bp, Artificial sequence
  Synthetic Oligonucleotide
atttgcctcagttcattcaa

SEQ ID NO: 438 - DNA, 20 bp, Artificial sequence
  Synthetic Oligonucleotide
ttaaatttgcctcagttcat

SEQ ID NO: 439 - DNA, 20 bp, Artificial sequence
  Synthetic Oligonucleotide
gccttttaaatttgcctcag

SEQ ID NO: 440 - DNA, 20 bp, Artificial sequence
  Synthetic Oligonucleotide
aggatttaataccagattat

SEQ ID NO: 441 - DNA, 20 bp, Artificial sequence
  Synthetic Oligonucleotide
cttaaggatttaataccaga

SEQ ID NO: 442 - DNA, 20 bp, Artificial sequence
  Synthetic Oligonucleotide
tctcttaaggatttaatacc

SEQ ID NO: 443 - DNA, 20 bp, Artificial sequence
  Synthetic Oligonucleotide
gacagtgactttaagataaa

SEQ ID NO: 444 - DNA, 20 bp, Artificial sequence
  Synthetic Oligonucleotide
tgtgattgtatgtttaatct

SEQ ID NO: 445 - DNA, 20 bp, Artificial sequence
  Synthetic Oligonucleotide
aggttatgtgattgtatgtt

SEQ ID NO: 446 - DNA, 20 bp, Artificial sequence
  Synthetic Oligonucleotide
ctttaaggttatgtgattgt

SEQ ID NO: 447 - DNA, 20 bp, Artificial sequence
  Synthetic Oligonucleotide
ggtattctttaaggttatgt

SEQ ID NO: 448 - DNA, 20 bp, Artificial sequence
  Synthetic Oligonucleotide
attgattcccacatcacaaa

SEQ ID NO: 449 - DNA, 20 bp, Artificial sequence
  Synthetic Oligonucleotide
ctaaaattgattcccacatc

SEQ ID NO: 450 - DNA, 20 bp, Artificial sequence
  Synthetic Oligonucleotide
ccatctaaaattgattccca

SEQ ID NO: 451 - DNA, 20 bp, Artificial sequence
  Synthetic Oligonucleotide
ttgtgatattagctcatatg

SEQ ID NO: 452 - DNA, 20 bp, Artificial sequence
  Synthetic Oligonucleotide
actagttttttaaactggga

SEQ ID NO: 453 - DNA, 20 bp, Artificial sequence
  Synthetic Oligonucleotide
gtcaagtttagagttttaac

SEQ ID NO: 454 - DNA, 20 bp, Artificial sequence
  Synthetic Oligonucleotide
tatttagtcaagtttagagt

SEQ ID NO: 455 - DNA, 20 bp, Artificial sequence
  Synthetic Oligonucleotide
gatttttacacatactctgt

SEQ ID NO: 456 - DNA, 20 bp, Artificial sequence
  Synthetic Oligonucleotide
ctgcttcattaggtttcata

SEQ ID NO: 457 - DNA, 20 bp, Artificial sequence
  Synthetic Oligonucleotide
cagcaggaatgccatcatgt

SEQ ID NO: 458 - DNA, 20 bp, Artificial sequence
  Synthetic Oligonucleotide
tgatggcatacatgccactt

SEQ ID NO: 459 - DNA, 20 bp, Artificial sequence
  Synthetic Oligonucleotide
tgctgggtctgatggcatac

SEQ ID NO: 460 - DNA, 20 bp, Artificial sequence
  Synthetic Oligonucleotide
gagttgctgggtctgatggc

SEQ ID NO: 461 - DNA, 20 bp, Artificial sequence
  Synthetic Oligonucleotide
aaaacttgagagttgctggg

SEQ ID NO: 462 - DNA, 20 bp, Artificial sequence
  Synthetic Oligonucleotide
gacatgaaaaacttgagagt

SEQ ID NO: 463 - DNA, 20 bp, Artificial sequence
  Synthetic Oligonucleotide
acatcacagtagacatgaaa

SEQ ID NO: 464 - DNA, 20 bp, Artificial sequence
  Synthetic Oligonucleotide
agttttgtgatccatctatt

SEQ ID NO: 465 - DNA, 20 bp, Artificial sequence
  Synthetic Oligonucleotide
tgaagttttgtgatccatct

SEQ ID NO: 466 - DNA, 20 bp, Artificial sequence
  Synthetic Oligonucleotide
cgtttcattgaagttttgtg

SEQ ID NO: 467 - DNA, 20 bp, Artificial sequence
  Synthetic Oligonucleotide
ccatatttgtagttctccca

SEQ ID NO: 468 - DNA, 20 bp, Artificial sequence
  Synthetic Oligonucleotide
aaaccatatttgtagttctc

SEQ ID NO: 469 - DNA, 20 bp, Artificial sequence
  Synthetic Oligonucleotide
aattctccatcaagcctccc

SEQ ID NO: 470 - DNA, 20 bp, Artificial sequence
  Synthetic Oligonucleotide
atcttctctaggcccaacca

SEQ ID NO: 471 - DNA, 20 bp, Artificial sequence
  Synthetic Oligonucleotide
gagtatatcttctctaggcc

SEQ ID NO: 472 - DNA, 20 bp, Artificial sequence
  Synthetic Oligonucleotide
ctatggagtatatcttctct

SEQ ID NO: 473 - DNA, 20 bp, Artificial sequence
  Synthetic Oligonucleotide
gcttcactatggagtatatc

SEQ ID NO: 474 - DNA, 20 bp, Artificial sequence
  Synthetic Oligonucleotide
agattgcttcactatggagt

SEQ ID NO: 475 - DNA, 20 bp, Artificial sequence
  Synthetic Oligonucleotide
ccagtcttccaactcaattc

SEQ ID NO: 476 - DNA, 20 bp, Artificial sequence
  Synthetic Oligonucleotide
gtctttccagtcttccaact

SEQ ID NO: 477 - DNA, 20 bp, Artificial sequence
  Synthetic Oligonucleotide
gtttgttgtctttccagtct

SEQ ID NO: 478 - DNA, 20 bp, Artificial sequence
  Synthetic Oligonucleotide
aatgtttgttgtctttccag

SEQ ID NO: 479 - DNA, 20 bp, Artificial sequence
  Synthetic Oligonucleotide
cgtgatttcccaagtaaaaa

SEQ ID NO: 480 - DNA, 20 bp, Artificial sequence
  Synthetic Oligonucleotide
gttttccgggattgcattgg

SEQ ID NO: 481 - DNA, 20 bp, Artificial sequence
  Synthetic Oligonucleotide
tctttgttttccgggattgc

SEQ ID NO: 482 - DNA, 20 bp, Artificial sequence
  Synthetic Oligonucleotide
ccaaatctttgttttccggg

SEQ ID NO: 483 - DNA, 20 bp, Artificial sequence
  Synthetic Oligonucleotide
acaccaaatctttgttttcc

SEQ ID NO: 484 - DNA, 20 bp, Artificial sequence
  Synthetic Oligonucleotide
agaaaacaccaaatctttgt

SEQ ID NO: 485 - DNA, 20 bp, Artificial sequence
  Synthetic Oligonucleotide
caagtagaaaacaccaaatc

SEQ ID NO: 486 - DNA, 20 bp, Artificial sequence
  Synthetic Oligonucleotide
gatcccaagtagaaaacacc

SEQ ID NO: 487 - DNA, 20 bp, Artificial sequence
  Synthetic Oligonucleotide
tttgctttgtgatcccaagt

SEQ ID NO: 488 - DNA, 20 bp, Artificial sequence
  Synthetic Oligonucleotide
tccttttgctttgtgatccc

SEQ ID NO: 489 - DNA, 20 bp, Artificial sequence
  Synthetic Oligonucleotide
gaagtgtccttttgctttgt

SEQ ID NO: 490 - DNA, 20 bp, Artificial sequence
  Synthetic Oligonucleotide
tgccaccaccagcctcctga

SEQ ID NO: 491 - DNA, 20 bp, Artificial sequence
  Synthetic Oligonucleotide
ctcatcatgccaccaccagc

SEQ ID NO: 492 - DNA, 20 bp, Artificial sequence
  Synthetic Oligonucleotide
ccatttaggttgttttctcc

SEQ ID NO: 493 - DNA, 20 bp, Artificial sequence
  Synthetic Oligonucleotide
atatttaccatttaggttgt

SEQ ID NO: 494 - DNA, 20 bp, Artificial sequence
  Synthetic Oligonucleotide
cttggtttgttatatttacc

SEQ ID NO: 495 - DNA, 20 bp, Artificial sequence
  Synthetic Oligonucleotide
atagagtataaccttccatt

SEQ ID NO: 496 - DNA, 20 bp, Artificial sequence
  Synthetic Oligonucleotide
ttttatagagtataaccttc

SEQ ID NO: 497 - DNA, 20 bp, Artificial sequence
  Synthetic Oligonucleotide
tggttgattttatagagtat

SEQ ID NO: 498 - DNA, 20 bp, Artificial sequence
  Synthetic Oligonucleotide
attttggttgattttataga

SEQ ID NO: 499 - DNA, 20 bp, Artificial sequence
  Synthetic Oligonucleotide
tcaacattttggttgatttt

SEQ ID NO: 500 - DNA, 20 bp, Artificial sequence
  Synthetic Oligonucleotide
ggatggatcaacattttggt

SEQ ID NO: 501 - DNA, 20 bp, Artificial sequence
  Synthetic Oligonucleotide
gttggatggatcaacatttt

SEQ ID NO: 502 - DNA, 20 bp, Artificial sequence
  Synthetic Oligonucleotide
tctgttggatggatcaacat

SEQ ID NO: 503 - DNA, 20 bp, Artificial sequence
  Synthetic Oligonucleotide
ctgaatctgttggatggatc

SEQ ID NO: 504 - DNA, 20 bp, Artificial sequence
  Synthetic Oligonucleotide
agctttctgaatctgttgga

SEQ ID NO: 505 - DNA, 20 bp, Artificial sequence
  Synthetic Oligonucleotide
cattcaaagctttctgaatc

SEQ ID NO: 506 - DNA, 20 bp, Artificial sequence
  Synthetic Oligonucleotide
gttcattcaaagctttctga

SEQ ID NO: 507 - DNA, 20 bp, Artificial sequence
  Synthetic Oligonucleotide
tcagttcattcaaagctttc

SEQ ID NO: 508 - DNA, 20 bp, Artificial sequence
  Synthetic Oligonucleotide
gcctcagttcattcaaagct

SEQ ID NO: 509 - DNA, 20 bp, Artificial sequence
  Synthetic Oligonucleotide
atttgcctcagttcattcaa

SEQ ID NO: 510 - DNA, 20 bp, Artificial sequence
  Synthetic Oligonucleotide
ttaaatttgcctcagttcat

SEQ ID NO: 511 - DNA, 20 bp, Artificial sequence
  Synthetic Oligonucleotide
gccttttaaatttgcctcag

SEQ ID NO: 512 - DNA, 20 bp, Artificial sequence
  Synthetic Oligonucleotide
aggatttaataccagattat

SEQ ID NO: 513 - DNA, 20 bp, Artificial sequence
  Synthetic Oligonucleotide
cttaaggatttaataccaga

SEQ ID NO: 514 - DNA, 20 bp, Artificial sequence
  Synthetic Oligonucleotide
tctcttaaggatttaatacc

SEQ ID NO: 515 - DNA, 20 bp, Artificial sequence
  Synthetic Oligonucleotide
gacagtgactttaagataaa

SEQ ID NO: 516 - DNA, 20 bp, Artificial sequence
  Synthetic Oligonucleotide
tgtgattgtatgtttaatct

SEQ ID NO: 517 - DNA, 20 bp, Artificial sequence
  Synthetic Oligonucleotide
aggttatgtgattgtatgtt

SEQ ID NO: 518 - DNA, 20 bp, Artificial sequence
  Synthetic Oligonucleotide
ctttaaggttatgtgattgt

SEQ ID NO: 519 - DNA, 20 bp, Artificial sequence
  Synthetic Oligonucleotide
ggtattctttaaggttatgt

SEQ ID NO: 520 - DNA, 20 bp, Artificial sequence
  Synthetic Oligonucleotide
attgattcccacatcacaaa

SEQ ID NO: 521 - DNA, 20 bp, Artificial sequence
  Synthetic Oligonucleotide
ctaaaattgattcccacatc

SEQ ID NO: 522 - DNA, 20 bp, Artificial sequence
  Synthetic Oligonucleotide
ccatctaaaattgattccca

SEQ ID NO: 523 - DNA, 20 bp, Artificial sequence
  Synthetic Oligonucleotide
ttgtgatattagctcatatg

SEQ ID NO: 524 - DNA, 20 bp, Artificial sequence
  Synthetic Oligonucleotide
actagttttttaaactggga

SEQ ID NO: 525 - DNA, 20 bp, Artificial sequence
  Synthetic Oligonucleotide
gtcaagtttagagttttaac

SEQ ID NO: 526 - DNA, 20 bp, Artificial sequence
  Synthetic Oligonucleotide
tatttagtcaagtttagagt

SEQ ID NO: 527 - DNA, 20 bp, Artificial sequence
  Synthetic Oligonucleotide
gatttttacacatactctgt

SEQ ID NO: 528 - DNA, 20 bp, Artificial sequence
  Synthetic Oligonucleotide
ctgcttcattaggtttcata

SEQ ID NO: 529 - DNA, 20 bp, Artificial sequence
  Synthetic Oligonucleotide
cagcaggaatgccatcatgt

SEQ ID NO: 530 - DNA, 20 bp, Artificial sequence
  Synthetic Oligonucleotide
tgatggcatacatgccactt

SEQ ID NO: 531 - DNA, 20 bp, Artificial sequence
  Synthetic Oligonucleotide
tgctgggtctgatggcatac

SEQ ID NO: 532 - DNA, 20 bp, Artificial sequence
  Synthetic Oligonucleotide
gagttgctgggtctgatggc

SEQ ID NO: 533 - DNA, 20 bp, Artificial sequence
  Synthetic Oligonucleotide
aaaacttgagagttgctggg

SEQ ID NO: 534 - DNA, 20 bp, Artificial sequence
  Synthetic Oligonucleotide
gacatgaaaaacttgagagt

SEQ ID NO: 535 - DNA, 20 bp, Artificial sequence
  Synthetic Oligonucleotide
acatcacagtagacatgaaa

SEQ ID NO: 536 - DNA, 20 bp, Artificial sequence
  Synthetic Oligonucleotide
agttttgtgatccatctatt

SEQ ID NO: 537 - DNA, 20 bp, Artificial sequence
  Synthetic Oligonucleotide
tgaagttttgtgatccatct

SEQ ID NO: 538 - DNA, 20 bp, Artificial sequence
  Synthetic Oligonucleotide
cgtttcattgaagttttgtg

SEQ ID NO: 539 - DNA, 20 bp, Artificial sequence
  Synthetic Oligonucleotide
ccatatttgtagttctccca

SEQ ID NO: 540 - DNA, 20 bp, Artificial sequence
  Synthetic Oligonucleotide
aaaccatatttgtagttctc

SEQ ID NO: 541 - DNA, 20 bp, Artificial sequence
  Synthetic Oligonucleotide
aattctccatcaagcctccc

SEQ ID NO: 542 - DNA, 20 bp, Artificial sequence
  Synthetic Oligonucleotide
atcttctctaggcccaacca

SEQ ID NO: 543 - DNA, 20 bp, Artificial sequence
  Synthetic Oligonucleotide
gagtatatcttctctaggcc

SEQ ID NO: 544 - DNA, 20 bp, Artificial sequence
  Synthetic Oligonucleotide
ctatggagtatatcttctct

SEQ ID NO: 545 - DNA, 20 bp, Artificial sequence
  Synthetic Oligonucleotide
gcttcactatggagtatatc

SEQ ID NO: 546 - DNA, 20 bp, Artificial sequence
  Synthetic Oligonucleotide
agattgcttcactatggagt

SEQ ID NO: 547 - DNA, 20 bp, Artificial sequence
  Synthetic Oligonucleotide
ccagtcttccaactcaattc

SEQ ID NO: 548 - DNA, 20 bp, Artificial sequence
  Synthetic Oligonucleotide
gtctttccagtcttccaact

SEQ ID NO: 549 - DNA, 20 bp, Artificial sequence
  Synthetic Oligonucleotide
gtttgttgtctttccagtct

SEQ ID NO: 550 - DNA, 20 bp, Artificial sequence
  Synthetic Oligonucleotide
aatgtttgttgtctttccag

SEQ ID NO: 551 - DNA, 20 bp, Artificial sequence
  Synthetic Oligonucleotide
cgtgatttcccaagtaaaaa

SEQ ID NO: 552 - DNA, 20 bp, Artificial sequence
  Synthetic Oligonucleotide
gttttccgggattgcattgg

SEQ ID NO: 553 - DNA, 20 bp, Artificial sequence
  Synthetic Oligonucleotide
tctttgttttccgggattgc

SEQ ID NO: 554 - DNA, 20 bp, Artificial sequence
  Synthetic Oligonucleotide
ccaaatctttgttttccggg

SEQ ID NO: 555 - DNA, 20 bp, Artificial sequence
  Synthetic Oligonucleotide
acaccaaatctttgttttcc

SEQ ID NO: 556 - DNA, 20 bp, Artificial sequence
  Synthetic Oligonucleotide
agaaaacaccaaatctttgt

SEQ ID NO: 557 - DNA, 20 bp, Artificial sequence
  Synthetic Oligonucleotide
caagtagaaaacaccaaatc

SEQ ID NO: 558 - DNA, 20 bp, Artificial sequence
  Synthetic Oligonucleotide
gatcccaagtagaaaacacc

SEQ ID NO: 559 - DNA, 20 bp, Artificial sequence
  Synthetic Oligonucleotide
tttgctttgtgatcccaagt

SEQ ID NO: 560 - DNA, 20 bp, Artificial sequence
  Synthetic Oligonucleotide
tccttttgctttgtgatccc

SEQ ID NO: 561 - DNA, 20 bp, Artificial sequence
  Synthetic Oligonucleotide
gaagtgtccttttgctttgt

SEQ ID NO: 562 - DNA, 20 bp, Artificial sequence
  Synthetic Oligonucleotide
tgccaccaccagcctcctga

SEQ ID NO: 563 - DNA, 20 bp, Artificial sequence
  Synthetic Oligonucleotide
ctcatcatgccaccaccagc

SEQ ID NO: 564 - DNA, 20 bp, Artificial sequence
  Synthetic Oligonucleotide
ccatttaggttgttttctcc

SEQ ID NO: 565 - DNA, 20 bp, Artificial sequence
  Synthetic Oligonucleotide
atatttaccatttaggttgt

SEQ ID NO: 566 - DNA, 20 bp, Artificial sequence
  Synthetic Oligonucleotide
cttggtttgttatatttacc

SEQ ID NO: 567 - DNA, 20 bp, Artificial sequence
  Synthetic Oligonucleotide
atagagtataaccttccatt

SEQ ID NO: 568 - DNA, 20 bp, Artificial sequence
  Synthetic Oligonucleotide
ttttatagagtataaccttc

SEQ ID NO: 569 - DNA, 20 bp, Artificial sequence
  Synthetic Oligonucleotide
tggttgattttatagagtat

SEQ ID NO: 570 - DNA, 20 bp, Artificial sequence
  Synthetic Oligonucleotide
attttggttgattttataga

SEQ ID NO: 571 - DNA, 20 bp, Artificial sequence
  Synthetic Oligonucleotide
tcaacattttggttgatttt

SEQ ID NO: 572 - DNA, 20 bp, Artificial sequence
  Synthetic Oligonucleotide
ggatggatcaacattttggt

SEQ ID NO: 573 - DNA, 20 bp, Artificial sequence
  Synthetic Oligonucleotide
gttggatggatcaacatttt

SEQ ID NO: 574 - DNA, 20 bp, Artificial sequence
  Synthetic Oligonucleotide
tctgttggatggatcaacat

SEQ ID NO: 575 - DNA, 20 bp, Artificial sequence
  Synthetic Oligonucleotide
ctgaatctgttggatggatc

SEQ ID NO: 576 - DNA, 20 bp, Artificial sequence
  Synthetic Oligonucleotide
agctttctgaatctgttgga

SEQ ID NO: 577 - DNA, 20 bp, Artificial sequence
  Synthetic Oligonucleotide
cattcaaagctttctgaatc

SEQ ID NO: 578 - DNA, 20 bp, Artificial sequence
  Synthetic Oligonucleotide
gttcattcaaagctttctga

SEQ ID NO: 579 - DNA, 20 bp, Artificial sequence
  Synthetic Oligonucleotide
tcagttcattcaaagctttc

SEQ ID NO: 580 - DNA, 20 bp, Artificial sequence
  Synthetic Oligonucleotide
gcctcagttcattcaaagct

SEQ ID NO: 581 - DNA, 20 bp, Artificial sequence
  Synthetic Oligonucleotide
atttgcctcagttcattcaa

SEQ ID NO: 582 - DNA, 20 bp, Artificial sequence
  Synthetic Oligonucleotide
ttaaatttgcctcagttcat

SEQ ID NO: 583 - DNA, 20 bp, Artificial sequence
  Synthetic Oligonucleotide
gccttttaaatttgcctcag

SEQ ID NO: 584 - DNA, 20 bp, Artificial sequence
  Synthetic Oligonucleotide
aggatttaataccagattat

SEQ ID NO: 585 - DNA, 20 bp, Artificial sequence
  Synthetic Oligonucleotide
cttaaggatttaataccaga

SEQ ID NO: 586 - DNA, 20 bp, Artificial sequence
  Synthetic Oligonucleotide
tctcttaaggatttaatacc

SEQ ID NO: 587 - DNA, 20 bp, Artificial sequence
  Synthetic Oligonucleotide
gacagtgactttaagataaa

SEQ ID NO: 588 - DNA, 20 bp, Artificial sequence
  Synthetic Oligonucleotide
tgtgattgtatgtttaatct

SEQ ID NO: 589 - DNA, 20 bp, Artificial sequence
  Synthetic Oligonucleotide
aggttatgtgattgtatgtt

SEQ ID NO: 590 - DNA, 20 bp, Artificial sequence
  Synthetic Oligonucleotide
ctttaaggttatgtgattgt

SEQ ID NO: 591 - DNA, 20 bp, Artificial sequence
  Synthetic Oligonucleotide
ggtattctttaaggttatgt

SEQ ID NO: 592 - DNA, 20 bp, Artificial sequence
  Synthetic Oligonucleotide
attgattcccacatcacaaa

SEQ ID NO: 593 - DNA, 20 bp, Artificial sequence
  Synthetic Oligonucleotide
ctaaaattgattcccacatc

SEQ ID NO: 594 - DNA, 20 bp, Artificial sequence
  Synthetic Oligonucleotide
ccatctaaaattgattccca

SEQ ID NO: 595 - DNA, 20 bp, Artificial sequence
  Synthetic Oligonucleotide
ttgtgatattagctcatatg

SEQ ID NO: 596 - DNA, 20 bp, Artificial sequence
  Synthetic Oligonucleotide
actagttttttaaactggga

SEQ ID NO: 597 - DNA, 20 bp, Artificial sequence
  Synthetic Oligonucleotide
gtcaagtttagagttttaac

SEQ ID NO: 598 - DNA, 20 bp, Artificial sequence
  Synthetic Oligonucleotide
tatttagtcaagtttagagt

SEQ ID NO: 599 - DNA, 20 bp, Artificial sequence
  Synthetic Oligonucleotide
gatttttacacatactctgt

SEQ ID NO: 600 - DNA, 20 bp, Artificial sequence
  Synthetic Oligonucleotide
ctgcttcattaggtttcata

SEQ ID NO: 601 - DNA, 20 bp, Artificial sequence
  Synthetic Oligonucleotide
cagtgttattcagattgtac

SEQ ID NO: 602 - DNA, 20 bp, Artificial sequence
  Synthetic Oligonucleotide
agtgtcttaccatcatgttt

SEQ ID NO: 603 - DNA, 20 bp, Artificial sequence
  Synthetic Oligonucleotide
caccagcctcctaaaggaga

SEQ ID NO: 604 - DNA, 20 bp, Artificial sequence
  Synthetic Oligonucleotide
gaggaggtgaagtcagtgag

SEQ ID NO: 605 - DNA, 20 bp, Artificial sequence
  Synthetic Oligonucleotide
tagagtagaggaggtgaagt

SEQ ID NO: 606 - DNA, 20 bp, Artificial sequence
  Synthetic Oligonucleotide
tgtttgatgtgtttgaatac

SEQ ID NO: 607 - DNA, 20 bp, Artificial sequence
  Synthetic Oligonucleotide
gaaacaacaagggcaaaggc

SEQ ID NO: 608 - DNA, 20 bp, Artificial sequence
  Synthetic Oligonucleotide
tgtttgataacgaccctaag

SEQ ID NO: 609 - DNA, 20 bp, Artificial sequence
  Synthetic Oligonucleotide
tttttggttaagtgaccttg

SEQ ID NO: 610 - DNA, 20 bp, Artificial sequence
  Synthetic Oligonucleotide
gtagaagttttcagggatgg

SEQ ID NO: 611 - DNA, 20 bp, Artificial sequence
  Synthetic Oligonucleotide
aggaagtagaagttttcagg

SEQ ID NO: 612 - DNA, 20 bp, Artificial sequence
  Synthetic Oligonucleotide
aggtgagtgtgcaggagaaa

SEQ ID NO: 613 - DNA, 20 bp, Artificial sequence
  Synthetic Oligonucleotide
ttaaataaaggtgagtgtgc

SEQ ID NO: 614 - DNA, 20 bp, Artificial sequence
  Synthetic Oligonucleotide
agtgcaggaatagaagagat

SEQ ID NO: 615 - DNA, 20 bp, Artificial sequence
  Synthetic Oligonucleotide
cattttagtgcaggaataga

SEQ ID NO: 616 - DNA, 20 bp, Artificial sequence
  Synthetic Oligonucleotide
ctatattctggagtatatac

SEQ ID NO: 617 - DNA, 20 bp, Artificial sequence
  Synthetic Oligonucleotide
cagtattctatattctggag

SEQ ID NO: 618 - DNA, 20 bp, Artificial sequence
  Synthetic Oligonucleotide
gtgccatacagtattctata

SEQ ID NO: 619 - DNA, 20 bp, Artificial sequence
  Synthetic Oligonucleotide
ctgtgtgaatatgacattac

SEQ ID NO: 620 - DNA, 20 bp, Artificial sequence
  Synthetic Oligonucleotide
tgaggcacactatttctagt

SEQ ID NO: 621 - DNA, 20 bp, Artificial sequence
  Synthetic Oligonucleotide
gacctttaattatgaggcac

SEQ ID NO: 622 - DNA, 20 bp, Artificial sequence
  Synthetic Oligonucleotide
gaatgttgacctttaattat

SEQ ID NO: 623 - DNA, 20 bp, Artificial sequence
  Synthetic Oligonucleotide
ttgttgaatgttgaccttta

SEQ ID NO: 624 - DNA, 20 bp, Artificial sequence
  Synthetic Oligonucleotide
tctactaagtaactatgtga

SEQ ID NO: 625 - DNA, 20 bp, Artificial sequence
  Synthetic Oligonucleotide
ctcttttctactaagtaact

SEQ ID NO: 626 - DNA, 20 bp, Artificial sequence
  Synthetic Oligonucleotide
aaggatctattgtaaagttt

SEQ ID NO: 627 - DNA, 20 bp, Artificial sequence
  Synthetic Oligonucleotide
ctaggaccttatttaaaagg

SEQ ID NO: 628 - DNA, 20 bp, Artificial sequence
  Synthetic Oligonucleotide
atttcctaggaccttattta

SEQ ID NO: 629 - DNA, 20 bp, Artificial sequence
  Synthetic Oligonucleotide
ttgacagtaagaaaagcaga

SEQ ID NO: 630 - DNA, 20 bp, Artificial sequence
  Synthetic Oligonucleotide
ttctcattgacagtaagaaa

SEQ ID NO: 631 - DNA, 20 bp, Artificial sequence
  Synthetic Oligonucleotide
agtttttctcattgacagta

SEQ ID NO: 632 - DNA, 20 bp, Artificial sequence
  Synthetic Oligonucleotide
attgaatgatagtttttctc

SEQ ID NO: 633 - DNA, 20 bp, Artificial sequence
  Synthetic Oligonucleotide
ttgggtttgcaatttattga

SEQ ID NO: 634 - DNA, 20 bp, Artificial sequence
  Synthetic Oligonucleotide
agtgtgttgggtttgcaatt

SEQ ID NO: 635 - DNA, 20 bp, Artificial sequence
  Synthetic Oligonucleotide
tatttaagtgtgttgggttt

SEQ ID NO: 636 - DNA, 20 bp, Artificial sequence
  Synthetic Oligonucleotide
atatattcagtagtttatcg

SEQ ID NO: 637 - DNA, 20 bp, Artificial sequence
  Synthetic Oligonucleotide
agatgttggcaggttggcaa

SEQ ID NO: 638 - DNA, 20 bp, Artificial sequence
  Synthetic Oligonucleotide
tctgtagatgttggcaggtt

SEQ ID NO: 639 - DNA, 20 bp, Artificial sequence
  Synthetic Oligonucleotide
ttgataatttttgacctgta

SEQ ID NO: 640 - DNA, 20 bp, Artificial sequence
  Synthetic Oligonucleotide
ggctttcttgataatttgat

SEQ ID NO: 641 - DNA, 20 bp, Artificial sequence
  Synthetic Oligonucleotide
gtcttactgatcttcagacc

SEQ ID NO: 642 - DNA, 20 bp, Artificial sequence
  Synthetic Oligonucleotide
tttaggtcttactgatcttc

SEQ ID NO: 643 - DNA, 20 bp, Artificial sequence
  Synthetic Oligonucleotide
tcagttttaggtcttactga

SEQ ID NO: 644 - DNA, 20 bp, Artificial sequence
  Synthetic Oligonucleotide
tgatattctgttcagatttt

SEQ ID NO: 645 - DNA, 20 bp, Artificial sequence
  Synthetic Oligonucleotide
tagagactgctttgcttaga

SEQ ID NO: 646 - DNA, 20 bp, Artificial sequence
  Synthetic Oligonucleotide
aggccaaaagtagagactgc

SEQ ID NO: 647 - DNA, 20 bp, Artificial sequence
  Synthetic Oligonucleotide
ggcaaaaaagcagacattgg

SEQ ID NO: 648 - DNA, 20 bp, Artificial sequence
  Synthetic Oligonucleotide
aatcagggacattatttaat

SEQ ID NO: 649 - DNA, 20 bp, Artificial sequence
  Synthetic Oligonucleotide
tatttaatcagggacattat

SEQ ID NO: 650 - DNA, 20 bp, Artificial sequence
  Synthetic Oligonucleotide
ctcaaaatatttaatcaggg

SEQ ID NO: 651 - DNA, 20 bp, Artificial sequence
  Synthetic Oligonucleotide
tacctgttctcaaaatattt

SEQ ID NO: 652 - DNA, 20 bp, Artificial sequence
  Synthetic Oligonucleotide
gtacagattacctgttctca

SEQ ID NO: 653 - DNA, 20 bp, Artificial sequence
  Synthetic Oligonucleotide
ggtgtttgatatttagataa

SEQ ID NO: 654 - DNA, 20 bp, Artificial sequence
  Synthetic Oligonucleotide
ttgtctttcagttcataatg

SEQ ID NO: 655 - DNA, 20 bp, Artificial sequence
  Synthetic Oligonucleotide
acagtttgtctttcagttca

SEQ ID NO: 656 - DNA, 20 bp, Artificial sequence
  Synthetic Oligonucleotide
tctgagctgataaaagaata

SEQ ID NO: 657 - DNA, 20 bp, Artificial sequence
  Synthetic Oligonucleotide
cccaccaaagtgtcttacca

SEQ ID NO: 658 - DNA, 20 bp, Artificial sequence
  Synthetic Oligonucleotide
cttcaagaaggaaacccacc

SEQ ID NO: 659 - DNA, 20 bp, Artificial sequence
  Synthetic Oligonucleotide
aatagcttcaagaaggaaac

SEQ ID NO: 660 - DNA, 20 bp, Artificial sequence
  Synthetic Oligonucleotide
acaagtcctaagaataggga

SEQ ID NO: 661 - DNA, 20 bp, Artificial sequence
  Synthetic Oligonucleotide
gtctagaacaagtcctaaga

SEQ ID NO: 662 - DNA, 20 bp, Artificial sequence
  Synthetic Oligonucleotide
tctaataatcaagtccatat

SEQ ID NO: 663 - DNA, 20 bp, Artificial sequence
  Synthetic Oligonucleotide
accttctatattatctaata

SEQ ID NO: 664 - DNA, 20 bp, Artificial sequence
  Synthetic Oligonucleotide
gcatgtatctcttaaacagg

SEQ ID NO: 665 - DNA, 20 bp, Artificial sequence
  Synthetic Oligonucleotide
gtccagtgacctttaactcc

SEQ ID NO: 666 - DNA, 20 bp, Artificial sequence
  Synthetic Oligonucleotide
tcttaccaaactattttctt

SEQ ID NO: 667 - DNA, 20 bp, Artificial sequence
  Synthetic Oligonucleotide
gtaatgtttatgttaaagca

SEQ ID NO: 668 - DNA, 20 bp, Artificial sequence
  Synthetic Oligonucleotide
ttgtggcaaatgtagcattt

SEQ ID NO: 669 - DNA, 20 bp, Artificial sequence
  Synthetic Oligonucleotide
gagatttcacttgacatttt

SEQ ID NO: 670 - DNA, 20 bp, Artificial sequence
  Synthetic Oligonucleotide
ggagcttgagatttcacttg

SEQ ID NO: 671 - DNA, 20 bp, Artificial sequence
  Synthetic Oligonucleotide
catcagatttagtaatagga

SEQ ID NO: 672 - DNA, 20 bp, Artificial sequence
  Synthetic Oligonucleotide
gttattacatcagatttagt

SEQ ID NO: 673 - DNA, 20 bp, Artificial sequence
  Synthetic Oligonucleotide
cagcaggaatgcctagaatc

SEQ ID NO: 674 - DNA, 20 bp, Artificial sequence
  Synthetic Oligonucleotide
ctccttagacaggttttacc

SEQ ID NO: 675 - DNA, 20 bp, Artificial sequence
  Synthetic Oligonucleotide
gtctattctccttagacagg

SEQ ID NO: 676 - DNA, 20 bp, Artificial sequence
  Synthetic Oligonucleotide
atgaatgattgaatgtagtc

SEQ ID NO: 677 - DNA, 20 bp, Artificial sequence
  Synthetic Oligonucleotide
atatgaaggctgagactgct

SEQ ID NO: 678 - DNA, 20 bp, Artificial sequence
  Synthetic Oligonucleotide
ataaattatatgaaggctga

SEQ ID NO: 679 - DNA, 20 bp, Artificial sequence
  Synthetic Oligonucleotide
atatttaagaacagacatgt

SEQ ID NO: 680 - DNA, 20 bp, Artificial sequence
  Synthetic Oligonucleotide
atttgtaacagttactactt

SEQ ID NO: 681 - DNA, 20 bp, Artificial sequence
  Synthetic Oligonucleotide
cacagcttatttgtaacagt

SEQ ID NO: 682 - DNA, 20 bp, Artificial sequence
  Synthetic Oligonucleotide
gtgactaatgctaggagtgg

SEQ ID NO: 683 - DNA, 20 bp, Artificial sequence
  Synthetic Oligonucleotide
gaatagagtgactaatgcta

SEQ ID NO: 684 - DNA, 20 bp, Artificial sequence
  Synthetic Oligonucleotide
atgagagaatagagtgacta

SEQ ID NO: 685 - DNA, 20 bp, Artificial sequence
  Synthetic Oligonucleotide
tatactgtatgtctgagttt

SEQ ID NO: 686 - DNA, 20 bp, Artificial sequence
  Synthetic Oligonucleotide
aactaattcattataagcca

SEQ ID NO: 687 - DNA, 20 bp, Artificial sequence
  Synthetic Oligonucleotide
tttggattttaaacatctgt

SEQ ID NO: 688 - DNA, 20 bp, Artificial sequence
  Synthetic Oligonucleotide
tgtatgtgctttttggattt

SEQ ID NO: 689 - DNA, 20 bp, Artificial sequence
  Synthetic Oligonucleotide
catggatttttgtatgtgct

SEQ ID NO: 690 - DNA, 20 bp, Artificial sequence
  Synthetic Oligonucleotide
tcattcatggatttttgtat

SEQ ID NO: 691 - DNA, 20 bp, Artificial sequence
  Synthetic Oligonucleotide
acttagacatcattcatgga

SEQ ID NO: 692 - DNA, 20 bp, Artificial sequence
  Synthetic Oligonucleotide
gtgagtacttagacatcatt

SEQ ID NO: 693 - DNA, 20 bp, Artificial sequence
  Synthetic Oligonucleotide
tttataagtgagtacttaga

SEQ ID NO: 694 - DNA, 20 bp, Artificial sequence
  Synthetic Oligonucleotide
gtcttctactttataagtga

SEQ ID NO: 695 - DNA, 20 bp, Artificial sequence
  Synthetic Oligonucleotide
atgaatgtcttctactttat

SEQ ID NO: 696 - DNA, 20 bp, Artificial sequence
  Synthetic Oligonucleotide
caaatagtactgagcattta

SEQ ID NO: 697 - DNA, 20 bp, Artificial sequence
  Synthetic Oligonucleotide
ttagaagatttggagctaca

SEQ ID NO: 698 - DNA, 20 bp, Artificial sequence
  Synthetic Oligonucleotide
tcactattagaagatttgga

SEQ ID NO: 699 - DNA, 20 bp, Artificial sequence
  Synthetic Oligonucleotide
gggttacactcactattaga

SEQ ID NO: 700 - DNA, 20 bp, Artificial sequence
  Synthetic Oligonucleotide
acttacctgtcagcctttta

SEQ ID NO: 701 - DNA, 20 bp, Artificial sequence
  Synthetic Oligonucleotide
cttaccagaattaagtgagt

SEQ ID NO: 702 - DNA, 20 bp, Artificial sequence
  Synthetic Oligonucleotide
aatacaagtacaaatgggtt

SEQ ID NO: 703 - DNA, 20 bp, Artificial sequence
  Synthetic Oligonucleotide
ctggtaaatacaagtacaaa

SEQ ID NO: 704 - DNA, 20 bp, Artificial sequence
  Synthetic Oligonucleotide
ggattgctggtaaatacaag

SEQ ID NO: 705 - DNA, 20 bp, Artificial sequence
  Synthetic Oligonucleotide
tcattttaaggattgctggt

SEQ ID NO: 706 - DNA, 20 bp, Artificial sequence
  Synthetic Oligonucleotide
agttagtaggaagcttcatt

SEQ ID NO: 707 - DNA, 20 bp, Artificial sequence
  Synthetic Oligonucleotide
gctattgagttagtaggaag

SEQ ID NO: 708 - DNA, 20 bp, Artificial sequence
  Synthetic Oligonucleotide
agcatggttcttaataactt

SEQ ID NO: 709 - DNA, 20 bp, Artificial sequence
  Synthetic Oligonucleotide
ctttgtagaaaaagacagga

SEQ ID NO: 710 - DNA, 20 bp, Artificial sequence
  Synthetic Oligonucleotide
acctggcctttggtatttgc

SEQ ID NO: 711 - DNA, 20 bp, Artificial sequence
  Synthetic Oligonucleotide
agtctttatatggataaact

SEQ ID NO: 712 - DNA, 20 bp, Artificial sequence
  Synthetic Oligonucleotide
cgtcattggtagaggaatat

SEQ ID NO: 713 - DNA, 20 bp, Artificial sequence
  Synthetic Oligonucleotide
gattatcctttctataatgc

SEQ ID NO: 714 - DNA, 20 bp, Artificial sequence
  Synthetic Oligonucleotide
gtcttgaatcccttgatcat

SEQ ID NO: 715 - DNA, 20 bp, Artificial sequence
  Synthetic Oligonucleotide
ggtgcaactaattgagttgt

SEQ ID NO: 716 - DNA, 20 bp, Artificial sequence
  Synthetic Oligonucleotide
gtgttttttattggtgcaac

SEQ ID NO: 717 - DNA, 20 bp, Artificial sequence
  Synthetic Oligonucleotide
attctcctgaaaagaaaagt

SEQ ID NO: 718 - DNA, 20 bp, Artificial sequence
  Synthetic Oligonucleotide
atgccaccaccagcctccta

SEQ ID NO: 719 - DNA, 20 bp, Artificial sequence
  Synthetic Oligonucleotide
atatcctttaacaaatgggt

SEQ ID NO: 720 - DNA, 20 bp, Artificial sequence
  Synthetic Oligonucleotide
gcactatatcctttaacaaa

SEQ ID NO: 721 - DNA, 20 bp, Artificial sequence
  Synthetic Oligonucleotide
acttgggcactatatccttt

SEQ ID NO: 722 - DNA, 20 bp, Artificial sequence
  Synthetic Oligonucleotide
gaaacatgtcctatgagagt

SEQ ID NO: 723 - DNA, 20 bp, Artificial sequence
  Synthetic Oligonucleotide
ttgagcactttaagcaaagt

SEQ ID NO: 724 - DNA, 20 bp, Artificial sequence
  Synthetic Oligonucleotide
ggaatttgagcactttaagc

SEQ ID NO: 725 - DNA, 20 bp, Artificial sequence
  Synthetic Oligonucleotide
tagattagacaactgtgagt

SEQ ID NO: 726 - DNA, 20 bp, Artificial sequence
  Synthetic Oligonucleotide
aaaatgaaggtcaagtttga

SEQ ID NO: 727 - DNA, 20 bp, Artificial sequence
  Synthetic Oligonucleotide
gtgaaagcaaaatgaaggtc

SEQ ID NO: 728 - DNA, 20 bp, Artificial sequence
  Synthetic Oligonucleotide
gtattgtgaaagcaaaatga

SEQ ID NO: 729 - DNA, 20 bp, Artificial sequence
  Synthetic Oligonucleotide
tggagagtatagtattgtga

SEQ ID NO: 730 - DNA, 20 bp, Artificial sequence
  Synthetic Oligonucleotide
aggaatagaagagataaata

SEQ ID NO: 731 - DNA, 20 bp, Artificial sequence
  Synthetic Oligonucleotide
tggagtatatacaaataatg

SEQ ID NO: 732 - DNA, 20 bp, Artificial sequence
  Synthetic Oligonucleotide
tgtttacattgtagattaat

SEQ ID NO: 733 - DNA, 20 bp, Artificial sequence
  Synthetic Oligonucleotide
cagaatatataatatcttgc

SEQ ID NO: 734 - DNA, 20 bp, Artificial sequence
  Synthetic Oligonucleotide
tgcaatttattgaatgatag

SEQ ID NO: 735 - DNA, 20 bp, Artificial sequence
  Synthetic Oligonucleotide
cataatacataatttgaacc

SEQ ID NO: 736 - DNA, 20 bp, Artificial sequence
  Synthetic Oligonucleotide
ataattttcagttttaggtc

SEQ ID NO: 737 - DNA, 20 bp, Artificial sequence
  Synthetic Oligonucleotide
tttcagtaatgtttatgtta

SEQ ID NO: 738 - DNA, 20 bp, Artificial sequence
  Synthetic Oligonucleotide
aatgcctagaatcaataaaa

SEQ ID NO: 739 - DNA, 20 bp, Artificial sequence
  Synthetic Oligonucleotide
gtaaatatttgtagattagc

SEQ ID NO: 740 - DNA, 20 bp, Artificial sequence
  Synthetic Oligonucleotide
acaaatgtgtaattgtttga

SEQ ID NO: 741 - DNA, 20 bp, Artificial sequence
  Synthetic Oligonucleotide
tactaacaaatgtgtaattg

SEQ ID NO: 742 - DNA, 20 bp, Artificial sequence
  Synthetic Oligonucleotide
tgataagtatatttaagaac

SEQ ID NO: 743 - DNA, 20 bp, Artificial sequence
  Synthetic Oligonucleotide
ttaacttccaattaattgat

SEQ ID NO: 744 - DNA, 20 bp, Artificial sequence
  Synthetic Oligonucleotide
tctgttattttatcttgctt

SEQ ID NO: 745 - DNA, 20 bp, Artificial sequence
  Synthetic Oligonucleotide
atcacaatcctttttattaa

SEQ ID NO: 746 - DNA, 20 bp, Artificial sequence
  Synthetic Oligonucleotide
agagacttgagtaataataa

SEQ ID NO: 747 - DNA, 20 bp, Artificial sequence
  Synthetic Oligonucleotide
aacaaaatgaaacatgtcct

SEQ ID NO: 748 - DNA, 20 bp, Artificial sequence
  Synthetic Oligonucleotide
cagcaggaatgccatcatgt

SEQ ID NO: 749 - DNA, 20 bp, Artificial sequence
  Synthetic Oligonucleotide
tgatggcatacatgccactt

SEQ ID NO: 750 - DNA, 20 bp, Artificial sequence
  Synthetic Oligonucleotide
tgctgggtctgatggcatac

SEQ ID NO: 751 - DNA, 20 bp, Artificial sequence
  Synthetic Oligonucleotide
gagttgctgggtctgatggc

SEQ ID NO: 752 - DNA, 20 bp, Artificial sequence
  Synthetic Oligonucleotide
aaaacttgagagttgctggg

SEQ ID NO: 753 - DNA, 20 bp, Artificial sequence
  Synthetic Oligonucleotide
gacatgaaaaacttgagagt

SEQ ID NO: 754 - DNA, 20 bp, Artificial sequence
  Synthetic Oligonucleotide
acatcacagtagacatgaaa

SEQ ID NO: 755 - DNA, 20 bp, Artificial sequence
  Synthetic Oligonucleotide
agttttgtgatccatctatt

SEQ ID NO: 756 - DNA, 20 bp, Artificial sequence
  Synthetic Oligonucleotide
tgaagttttgtgatccatct

SEQ ID NO: 757 - DNA, 20 bp, Artificial sequence
  Synthetic Oligonucleotide
cgtttcattgaagttttgtg

SEQ ID NO: 758 - DNA, 20 bp, Artificial sequence
  Synthetic Oligonucleotide
ccatatttgtagttctccca

SEQ ID NO: 759 - DNA, 20 bp, Artificial sequence
  Synthetic Oligonucleotide
aaaccatatttgtagttctc

SEQ ID NO: 760 - DNA, 20 bp, Artificial sequence
  Synthetic Oligonucleotide
aattctccatcaagcctccc

SEQ ID NO: 761 - DNA, 20 bp, Artificial sequence
  Synthetic Oligonucleotide
atcttctctaggcccaacca

SEQ ID NO: 762 - DNA, 20 bp, Artificial sequence
  Synthetic Oligonucleotide
gagtatatcttctctaggcc

SEQ ID NO: 763 - DNA, 20 bp, Artificial sequence
  Synthetic Oligonucleotide
ctatggagtatatcttctct

SEQ ID NO: 764 - DNA, 20 bp, Artificial sequence
  Synthetic Oligonucleotide
gcttcactatggagtatatc

SEQ ID NO: 765 - DNA, 20 bp, Artificial sequence
  Synthetic Oligonucleotide
agattgcttcactatggagt

SEQ ID NO: 766 - DNA, 20 bp, Artificial sequence
  Synthetic Oligonucleotide
ccagtcttccaactcaattc

SEQ ID NO: 767 - DNA, 20 bp, Artificial sequence
  Synthetic Oligonucleotide
gtctttccagtcttccaact

SEQ ID NO: 768 - DNA, 20 bp, Artificial sequence
  Synthetic Oligonucleotide
gtttgttgtctttccagtct

SEQ ID NO: 769 - DNA, 20 bp, Artificial sequence
  Synthetic Oligonucleotide
aatgtttgttgtctttccag

SEQ ID NO: 770 - DNA, 20 bp, Artificial sequence
  Synthetic Oligonucleotide
cgtgatttcccaagtaaaaa

SEQ ID NO: 771 - DNA, 20 bp, Artificial sequence
  Synthetic Oligonucleotide
gttttccgggattgcattgg

SEQ ID NO: 772 - DNA, 20 bp, Artificial sequence
  Synthetic Oligonucleotide
tctttgttttccgggattgc

SEQ ID NO: 773 - DNA, 20 bp, Artificial sequence
  Synthetic Oligonucleotide
ccaaatctttgttttccggg

SEQ ID NO: 774 - DNA, 20 bp, Artificial sequence
  Synthetic Oligonucleotide
acaccaaatctttgttttcc

SEQ ID NO: 775 - DNA, 20 bp, Artificial sequence
  Synthetic Oligonucleotide
agaaaacaccaaatctttgt

SEQ ID NO: 776 - DNA, 20 bp, Artificial sequence
  Synthetic Oligonucleotide
caagtagaaaacaccaaatc

SEQ ID NO: 777 - DNA, 20 bp, Artificial sequence
  Synthetic Oligonucleotide
gatcccaagtagaaaacacc

SEQ ID NO: 778 - DNA, 20 bp, Artificial sequence
  Synthetic Oligonucleotide
tttgctttgtgatcccaagt

SEQ ID NO: 779 - DNA, 20 bp, Artificial sequence
  Synthetic Oligonucleotide
tccttttgctttgtgatccc

SEQ ID NO: 780 - DNA, 20 bp, Artificial sequence
  Synthetic Oligonucleotide
gaagtgtccttttgctttgt

SEQ ID NO: 781 - DNA, 20 bp, Artificial sequence
  Synthetic Oligonucleotide
tgccaccaccagcctcctga

SEQ ID NO: 782 - DNA, 20 bp, Artificial sequence
  Synthetic Oligonucleotide
ctcatcatgccaccaccagc

SEQ ID NO: 783 - DNA, 20 bp, Artificial sequence
  Synthetic Oligonucleotide
ccatttaggttgttttctcc

SEQ ID NO: 784 - DNA, 20 bp, Artificial sequence
  Synthetic Oligonucleotide
atatttaccatttaggttgt

SEQ ID NO: 785 - DNA, 20 bp, Artificial sequence
  Synthetic Oligonucleotide
cttggtttgttatatttacc

SEQ ID NO: 786 - DNA, 20 bp, Artificial sequence
  Synthetic Oligonucleotide
atagagtataaccttccatt

SEQ ID NO: 787 - DNA, 20 bp, Artificial sequence
  Synthetic Oligonucleotide
ttttatagagtataaccttc

SEQ ID NO: 788 - DNA, 20 bp, Artificial sequence
  Synthetic Oligonucleotide
tggttgattttatagagtat

SEQ ID NO: 789 - DNA, 20 bp, Artificial sequence
  Synthetic Oligonucleotide
attttggttgattttataga

SEQ ID NO: 790 - DNA, 20 bp, Artificial sequence
  Synthetic Oligonucleotide
tcaacattttggttgatttt

SEQ ID NO: 791 - DNA, 20 bp, Artificial sequence
  Synthetic Oligonucleotide
ggatggatcaacattttggt

SEQ ID NO: 792 - DNA, 20 bp, Artificial sequence
  Synthetic Oligonucleotide
gttggatggatcaacatttt

SEQ ID NO: 793 - DNA, 20 bp, Artificial sequence
  Synthetic Oligonucleotide
tctgttggatggatcaacat

SEQ ID NO: 794 - DNA, 20 bp, Artificial sequence
  Synthetic Oligonucleotide
ctgaatctgttggatggatc

SEQ ID NO: 795 - DNA, 20 bp, Artificial sequence
  Synthetic Oligonucleotide
agctttctgaatctgttgga

SEQ ID NO: 796 - DNA, 20 bp, Artificial sequence
  Synthetic Oligonucleotide
cattcaaagctttctgaatc

SEQ ID NO: 797 - DNA, 20 bp, Artificial sequence
  Synthetic Oligonucleotide
gttcattcaaagctttctga

SEQ ID NO: 798 - DNA, 20 bp, Artificial sequence
  Synthetic Oligonucleotide
tcagttcattcaaagctttc

SEQ ID NO: 799 - DNA, 20 bp, Artificial sequence
  Synthetic Oligonucleotide
gcctcagttcattcaaagct

SEQ ID NO: 800 - DNA, 20 bp, Artificial sequence
  Synthetic Oligonucleotide
atttgcctcagttcattcaa

SEQ ID NO: 801 - DNA, 20 bp, Artificial sequence
  Synthetic Oligonucleotide
ttaaatttgcctcagttcat

SEQ ID NO: 802 - DNA, 20 bp, Artificial sequence
  Synthetic Oligonucleotide
gccttttaaatttgcctcag

SEQ ID NO: 803 - DNA, 20 bp, Artificial sequence
  Synthetic Oligonucleotide
aggatttaataccagattat

SEQ ID NO: 804 - DNA, 20 bp, Artificial sequence
  Synthetic Oligonucleotide
cttaaggatttaataccaga

SEQ ID NO: 805 - DNA, 20 bp, Artificial sequence
  Synthetic Oligonucleotide
tctcttaaggatttaatacc

SEQ ID NO: 806 - DNA, 20 bp, Artificial sequence
  Synthetic Oligonucleotide
gacagtgactttaagataaa

SEQ ID NO: 807 - DNA, 20 bp, Artificial sequence
  Synthetic Oligonucleotide
tgtgattgtatgtttaatct

SEQ ID NO: 808 - DNA, 20 bp, Artificial sequence
  Synthetic Oligonucleotide
aggttatgtgattgtatgtt

SEQ ID NO: 809 - DNA, 20 bp, Artificial sequence
  Synthetic Oligonucleotide
ctttaaggttatgtgattgt

SEQ ID NO: 810 - DNA, 20 bp, Artificial sequence
  Synthetic Oligonucleotide
ggtattctttaaggttatgt

SEQ ID NO: 811 - DNA, 20 bp, Artificial sequence
  Synthetic Oligonucleotide
attgattcccacatcacaaa

SEQ ID NO: 812 - DNA, 20 bp, Artificial sequence
  Synthetic Oligonucleotide
ctaaaattgattcccacatc

SEQ ID NO: 813 - DNA, 20 bp, Artificial sequence
  Synthetic Oligonucleotide
ccatctaaaattgattccca

SEQ ID NO: 814 - DNA, 20 bp, Artificial sequence
  Synthetic Oligonucleotide
ttgtgatattagctcatatg

SEQ ID NO: 815 - DNA, 20 bp, Artificial sequence
  Synthetic Oligonucleotide
actagttttttaaactggga

SEQ ID NO: 816 - DNA, 20 bp, Artificial sequence
  Synthetic Oligonucleotide
gtcaagtttagagttttaac

SEQ ID NO: 817 - DNA, 20 bp, Artificial sequence
  Synthetic Oligonucleotide
tatttagtcaagtttagagt

SEQ ID NO: 818 - DNA, 20 bp, Artificial sequence
  Synthetic Oligonucleotide
gatttttacacatactctgt

SEQ ID NO: 819 - DNA, 20 bp, Artificial sequence
  Synthetic Oligonucleotide
ctgcttcattaggtttcata

SEQ ID NO: 820 - DNA, 20 bp, Artificial sequence
  Synthetic Oligonucleotide
caccagcctcctaaaggaga

SEQ ID NO: 821 - DNA, 20 bp, Artificial sequence
  Synthetic Oligonucleotide
gacttcttaactctatatat

SEQ ID NO: 822 - DNA, 20 bp, Artificial sequence
  Synthetic Oligonucleotide
ctagacttcttaactctata

SEQ ID NO: 823 - DNA, 20 bp, Artificial sequence
  Synthetic Oligonucleotide
gacctagacttcttaactct

SEQ ID NO: 824 - DNA, 20 bp, Artificial sequence
  Synthetic Oligonucleotide
ggaagcagacctagacttct

SEQ ID NO: 825 - DNA, 20 bp, Artificial sequence
  Synthetic Oligonucleotide
tctggaagcagacctagact

SEQ ID NO: 826 - DNA, 20 bp, Artificial sequence
  Synthetic Oligonucleotide
tcttctggaagcagacctag

SEQ ID NO: 827 - DNA, 20 bp, Artificial sequence
  Synthetic Oligonucleotide
ctaatctttagggatttagg

SEQ ID NO: 828 - DNA, 20 bp, Artificial sequence
  Synthetic Oligonucleotide
tgtatctaatctttagggat

SEQ ID NO: 829 - DNA, 20 bp, Artificial sequence
  Synthetic Oligonucleotide
taacttgggcactatatcct

SEQ ID NO: 830 - DNA, 20 bp, Artificial sequence
  Synthetic Oligonucleotide
attgacaaaggtaggtcacc

SEQ ID NO: 831 - DNA, 20 bp, Artificial sequence
  Synthetic Oligonucleotide
atatgacatgtatattggat

SEQ ID NO: 832 - DNA, 20 bp, Artificial sequence
  Synthetic Oligonucleotide
ttttgtacttttctggaaca

SEQ ID NO: 833 - DNA, 20 bp, Artificial sequence
  Synthetic Oligonucleotide
tagtctgtggtcctgaaaat

SEQ ID NO: 834 - DNA, 20 bp, Artificial sequence
  Synthetic Oligonucleotide
agcttagtctgtggtcctga

SEQ ID NO: 835 - DNA, 20 bp, Artificial sequence
  Synthetic Oligonucleotide
gacagcttagtctgtggtcc

SEQ ID NO: 836 - DNA, 20 bp, Artificial sequence
  Synthetic Oligonucleotide
gtattctggccctaaaaaaa

SEQ ID NO: 837 - DNA, 20 bp, Artificial sequence
  Synthetic Oligonucleotide
attttggtattctggcccta

SEQ ID NO: 838 - DNA, 20 bp, Artificial sequence
  Synthetic Oligonucleotide
gaaattgtccaatttttggg

SEQ ID NO: 839 - DNA, 20 bp, Artificial sequence
  Synthetic Oligonucleotide
tttgcatttgaaattgtcca

SEQ ID NO: 840 - DNA, 20 bp, Artificial sequence
  Synthetic Oligonucleotide
ggaagcaactcatatattaa

SEQ ID NO: 841 - DNA, 20 bp, Artificial sequence
  Synthetic Oligonucleotide
tatcagaaaaagatacctga

SEQ ID NO: 842 - DNA, 20 bp, Artificial sequence
  Synthetic Oligonucleotide
ataatagctaataatgtggg

SEQ ID NO: 843 - DNA, 20 bp, Artificial sequence
  Synthetic Oligonucleotide
tgcagataatagctaataat

SEQ ID NO: 844 - DNA, 20 bp, Artificial sequence
  Synthetic Oligonucleotide
tgtcattgcagataatagct

SEQ ID NO: 845 - DNA, 20 bp, Artificial sequence
  Synthetic Oligonucleotide
taaaagttgtcattgcagat

SEQ ID NO: 846 - DNA, 20 bp, Artificial sequence
  Synthetic Oligonucleotide
cggatttttaaaagttgtca

SEQ ID NO: 847 - DNA, 20 bp, Artificial sequence
  Synthetic Oligonucleotide
gggattcggatttttaaaag

SEQ ID NO: 848 - DNA, 20 bp, Artificial sequence
  Synthetic Oligonucleotide
tttgggattcggatttttaa

SEQ ID NO: 849 - DNA, 20 bp, Artificial sequence
  Synthetic Oligonucleotide
acgcttatttgggattcgga

SEQ ID NO: 850 - DNA, 20 bp, Artificial sequence
  Synthetic Oligonucleotide
tttaagagatttacaagtca

SEQ ID NO: 851 - DNA, 20 bp, Artificial sequence
  Synthetic Oligonucleotide
gactacctgtttttaaaagc

SEQ ID NO: 852 - DNA, 20 bp, Artificial sequence
  Synthetic Oligonucleotide
tatggtgactacctgttttt

SEQ ID NO: 853 - DNA, 20 bp, Artificial sequence
  Synthetic Oligonucleotide
actttgctgtattataaact

SEQ ID NO: 854 - DNA, 20 bp, Artificial sequence
  Synthetic Oligonucleotide
attgtatttaactttgctgt

SEQ ID NO: 855 - DNA, 20 bp, Artificial sequence
  Synthetic Oligonucleotide
gagcaactaacttaataggt

SEQ ID NO: 856 - DNA, 20 bp, Artificial sequence
  Synthetic Oligonucleotide
gaaatgagcaactaacttaa

SEQ ID NO: 857 - DNA, 20 bp, Artificial sequence
  Synthetic Oligonucleotide
aatcaaagaaatgagcaact

SEQ ID NO: 858 - DNA, 20 bp, Artificial sequence
  Synthetic Oligonucleotide
accttcttccacattgagtt

SEQ ID NO: 859 - DNA, 20 bp, Artificial sequence
  Synthetic Oligonucleotide
cacgaatgtaaccttcttcc

SEQ ID NO: 860 - DNA, 20 bp, Artificial sequence
  Synthetic Oligonucleotide
ttaacttgcacgaatgtaac

SEQ ID NO: 861 - DNA, 20 bp, Artificial sequence
  Synthetic Oligonucleotide
tatatataccaatatttgcc

SEQ ID NO: 862 - DNA, 20 bp, Artificial sequence
  Synthetic Oligonucleotide
tcttaactctatatatacca

SEQ ID NO: 863 - DNA, 20 bp, Artificial sequence
  Synthetic Oligonucleotide
ctttaagtgaagttacttct

SEQ ID NO: 864 - DNA, 20 bp, Artificial sequence
  Synthetic Oligonucleotide
tctacttactttaagtgaag

SEQ ID NO: 865 - DNA, 20 bp, Artificial sequence
  Synthetic Oligonucleotide
gaaccctctttattttctac

SEQ ID NO: 866 - DNA, 20 bp, Artificial sequence
  Synthetic Oligonucleotide
acataaacatgaaccctctt

SEQ ID NO: 867 - DNA, 20 bp, Artificial sequence
  Synthetic Oligonucleotide
ccacattgaaaacataaaca

SEQ ID NO: 868 - DNA, 20 bp, Artificial sequence
  Synthetic Oligonucleotide
gcatgccttagaaatatttt

SEQ ID NO: 869 - DNA, 20 bp, Artificial sequence
  Synthetic Oligonucleotide
caatgcaacaaagtatttca

SEQ ID NO: 870 - DNA, 20 bp, Artificial sequence
  Synthetic Oligonucleotide
ctggagattatttttcttgg

SEQ ID NO: 871 - DNA, 20 bp, Artificial sequence
  Synthetic Oligonucleotide
ttcatatataacattaggga

SEQ ID NO: 872 - DNA, 20 bp, Artificial sequence
  Synthetic Oligonucleotide
tcagtgttttcatatataac

SEQ ID NO: 873 - DNA, 20 bp, Artificial sequence
  Synthetic Oligonucleotide
gacatagtgttctagattgt

SEQ ID NO: 874 - DNA, 20 bp, Artificial sequence
  Synthetic Oligonucleotide
caatagtgtaatgacatagt

SEQ ID NO: 875 - DNA, 20 bp, Artificial sequence
  Synthetic Oligonucleotide
ttacttaccttcagtaattt

SEQ ID NO: 876 - DNA, 20 bp, Artificial sequence
  Synthetic Oligonucleotide
atcttttccatttactgtat

SEQ ID NO: 877 - DNA, 20 bp, Artificial sequence
  Synthetic Oligonucleotide
agaaaaagcccagcatattt

SEQ ID NO: 878 - DNA, 20 bp, Artificial sequence
  Synthetic Oligonucleotide
gtatgcttctttcaaatagc

SEQ ID NO: 879 - DNA, 20 bp, Artificial sequence
  Synthetic Oligonucleotide
ccttccccttgtatgcttct

SEQ ID NO: 880 - DNA, 20 bp, Artificial sequence
  Synthetic Oligonucleotide
cctgtaacactatcataatc

SEQ ID NO: 881 - DNA, 20 bp, Artificial sequence
  Synthetic Oligonucleotide
tgacttacctgattttctat

SEQ ID NO: 882 - DNA, 20 bp, Artificial sequence
  Synthetic Oligonucleotide
gatgggacataccattaaaa

SEQ ID NO: 883 - DNA, 20 bp, Artificial sequence
  Synthetic Oligonucleotide
gtgaaagatgggacatacca

SEQ ID NO: 884 - DNA, 20 bp, Artificial sequence
  Synthetic Oligonucleotide
cctgtgtgaaagatgggaca

SEQ ID NO: 885 - DNA, 20 bp, Artificial sequence
  Synthetic Oligonucleotide
cattggctgctatgaattaa

SEQ ID NO: 886 - DNA, 20 bp, Artificial sequence
  Synthetic Oligonucleotide
gatgacattggctgctatga

SEQ ID NO: 887 - DNA, 20 bp, Artificial sequence
  Synthetic Oligonucleotide
gagaaacatgatctaatttg

SEQ ID NO: 888 - DNA, 20 bp, Artificial sequence
  Synthetic Oligonucleotide
atggaaagctattgtgtggt

SEQ ID NO: 889 - DNA, 20 bp, Artificial sequence
  Synthetic Oligonucleotide
gtctaaagagccaatatgag

SEQ ID NO: 890 - DNA, 20 bp, Artificial sequence
  Synthetic Oligonucleotide
aatcttggtctaaagagcca

SEQ ID NO: 891 - DNA, 20 bp, Artificial sequence
  Synthetic Oligonucleotide
ggagcttgagatttcacttg

SEQ ID NO: 892 - DNA, 20 bp, Artificial sequence
  Synthetic Oligonucleotide
catcagatttagtaatagga

SEQ ID NO: 893 - DNA, 20 bp, Artificial sequence
  Synthetic Oligonucleotide
gttattacatcagatttagt

SEQ ID NO: 894 - DNA, 20 bp, Artificial sequence
  Synthetic Oligonucleotide
cagcaggaatgcctagaatc

SEQ ID NO: 895 - DNA, 20 bp, Artificial sequence
  Synthetic Oligonucleotide
ctccttagacaggttttacc

SEQ ID NO: 896 - DNA, 20 bp, Artificial sequence
  Synthetic Oligonucleotide
gtctattctccttagacagg

SEQ ID NO: 897 - DNA, 20 bp, Artificial sequence
  Synthetic Oligonucleotide
atgaatgattgaatgtagtc

SEQ ID NO: 898 - DNA, 20 bp, Artificial sequence
  Synthetic Oligonucleotide
atatgaaggctgagactgct

SEQ ID NO: 899 - DNA, 20 bp, Artificial sequence
  Synthetic Oligonucleotide
ataaattatatgaaggctga

SEQ ID NO: 900 - DNA, 20 bp, Artificial sequence
  Synthetic Oligonucleotide
atatttaagaacagacatgt

SEQ ID NO: 901 - DNA, 20 bp, Artificial sequence
  Synthetic Oligonucleotide
atttgtaacagttactactt

SEQ ID NO: 902 - DNA, 20 bp, Artificial sequence
  Synthetic Oligonucleotide
cacagcttatttgtaacagt

SEQ ID NO: 903 - DNA, 20 bp, Artificial sequence
  Synthetic Oligonucleotide
gtgactaatgctaggagtgg

SEQ ID NO: 904 - DNA, 20 bp, Artificial sequence
  Synthetic Oligonucleotide
gaatagagtgactaatgcta

SEQ ID NO: 905 - DNA, 20 bp, Artificial sequence
  Synthetic Oligonucleotide
atgagagaatagagtgacta

SEQ ID NO: 906 - DNA, 20 bp, Artificial sequence
  Synthetic Oligonucleotide
tatactgtatgtctgagttt

SEQ ID NO: 907 - DNA, 20 bp, Artificial sequence
  Synthetic Oligonucleotide
aactaattcattataagcca

SEQ ID NO: 908 - DNA, 20 bp, Artificial sequence
  Synthetic Oligonucleotide
tttggattttaaacatctgt

SEQ ID NO: 909 - DNA, 20 bp, Artificial sequence
  Synthetic Oligonucleotide
tgtatgtgctttttggattt

SEQ ID NO: 910 - DNA, 20 bp, Artificial sequence
  Synthetic Oligonucleotide
catggatttttgtatgtgct

SEQ ID NO: 911 - DNA, 20 bp, Artificial sequence
  Synthetic Oligonucleotide
tcattcatggatttttgtat

SEQ ID NO: 912 - DNA, 20 bp, Artificial sequence
  Synthetic Oligonucleotide
acttagacatcattcatgga

SEQ ID NO: 913 - DNA, 20 bp, Artificial sequence
  Synthetic Oligonucleotide
gtgagtacttagacatcatt

SEQ ID NO: 914 - DNA, 20 bp, Artificial sequence
  Synthetic Oligonucleotide
tttataagtgagtacttaga

SEQ ID NO: 915 - DNA, 20 bp, Artificial sequence
  Synthetic Oligonucleotide
gtcttctactttataagtga

SEQ ID NO: 916 - DNA, 20 bp, Artificial sequence
  Synthetic Oligonucleotide
atgaatgtcttctactttat

SEQ ID NO: 917 - DNA, 20 bp, Artificial sequence
  Synthetic Oligonucleotide
caaatagtactgagcattta

SEQ ID NO: 918 - DNA, 20 bp, Artificial sequence
  Synthetic Oligonucleotide
ttagaagatttggagctaca

SEQ ID NO: 919 - DNA, 20 bp, Artificial sequence
  Synthetic Oligonucleotide
tcactattagaagatttgga

SEQ ID NO: 920 - DNA, 20 bp, Artificial sequence
  Synthetic Oligonucleotide
gggttacactcactattaga

SEQ ID NO: 921 - DNA, 20 bp, Artificial sequence
  Synthetic Oligonucleotide
acttacctgtcagcctttta

SEQ ID NO: 922 - DNA, 20 bp, Artificial sequence
  Synthetic Oligonucleotide
cttaccagaattaagtgagt

SEQ ID NO: 923 - DNA, 20 bp, Artificial sequence
  Synthetic Oligonucleotide
aatacaagtacaaatgggtt

SEQ ID NO: 924 - DNA, 20 bp, Artificial sequence
  Synthetic Oligonucleotide
ctggtaaatacaagtacaaa

SEQ ID NO: 925 - DNA, 20 bp, Artificial sequence
  Synthetic Oligonucleotide
ggattgctggtaaatacaag

SEQ ID NO: 926 - DNA, 20 bp, Artificial sequence
  Synthetic Oligonucleotide
tcattttaaggattgctggt

SEQ ID NO: 927 - DNA, 20 bp, Artificial sequence
  Synthetic Oligonucleotide
agttagtaggaagcttcatt

SEQ ID NO: 928 - DNA, 20 bp, Artificial sequence
  Synthetic Oligonucleotide
gctattgagttagtaggaag

SEQ ID NO: 929 - DNA, 20 bp, Artificial sequence
  Synthetic Oligonucleotide
agcatggttcttaataactt

SEQ ID NO: 930 - DNA, 20 bp, Artificial sequence
  Synthetic Oligonucleotide
ctttgtagaaaaagacagga

SEQ ID NO: 931 - DNA, 20 bp, Artificial sequence
  Synthetic Oligonucleotide
acctggcctttggtatttgc

SEQ ID NO: 932 - DNA, 20 bp, Artificial sequence
  Synthetic Oligonucleotide
agtctttatatggataaact

SEQ ID NO: 933 - DNA, 20 bp, Artificial sequence
  Synthetic Oligonucleotide
cgtcattggtagaggaatat

SEQ ID NO: 934 - DNA, 20 bp, Artificial sequence
  Synthetic Oligonucleotide
gattatcctttctataatgc

SEQ ID NO: 935 - DNA, 20 bp, Artificial sequence
  Synthetic Oligonucleotide
gtcttgaatcccttgatcat

SEQ ID NO: 936 - DNA, 20 bp, Artificial sequence
  Synthetic Oligonucleotide
ggtgcaactaattgagttgt

SEQ ID NO: 937 - DNA, 20 bp, Artificial sequence
  Synthetic Oligonucleotide
gtgttttttattggtgcaac

SEQ ID NO: 938 - DNA, 20 bp, Artificial sequence
  Synthetic Oligonucleotide
attctcctgaaaagaaaagt

SEQ ID NO: 939 - DNA, 20 bp, Artificial sequence
  Synthetic Oligonucleotide
atgccaccaccagcctccta

SEQ ID NO: 940 - DNA, 20 bp, Artificial sequence
  Synthetic Oligonucleotide
atatcctttaacaaatgggt

SEQ ID NO: 941 - DNA, 20 bp, Artificial sequence
  Synthetic Oligonucleotide
gcactatatcctttaacaaa

SEQ ID NO: 942 - DNA, 20 bp, Artificial sequence
  Synthetic Oligonucleotide
acttgggcactatatccttt

SEQ ID NO: 943 - DNA, 20 bp, Artificial sequence
  Synthetic Oligonucleotide
gaaacatgtcctatgagagt

SEQ ID NO: 944 - DNA, 20 bp, Artificial sequence
  Synthetic Oligonucleotide
ttgagcactttaagcaaagt

SEQ ID NO: 945 - DNA, 20 bp, Artificial sequence
  Synthetic Oligonucleotide
ggaatttgagcactttaagc

SEQ ID NO: 946 - DNA, 20 bp, Artificial sequence
  Synthetic Oligonucleotide
tagattagacaactgtgagt

SEQ ID NO: 947 - DNA, 20 bp, Artificial sequence
  Synthetic Oligonucleotide
aaaatgaaggtcaagtttga

SEQ ID NO: 948 - DNA, 20 bp, Artificial sequence
  Synthetic Oligonucleotide
gtgaaagcaaaatgaaggtc

SEQ ID NO: 949 - DNA, 20 bp, Artificial sequence
  Synthetic Oligonucleotide
gtattgtgaaagcaaaatga

SEQ ID NO: 950 - DNA, 20 bp, Artificial sequence
  Synthetic Oligonucleotide
tggagagtatagtattgtga

SEQ ID NO: 951 - DNA, 20 bp, Artificial sequence
  Synthetic Oligonucleotide
gagatttacaagtcaaaaat

SEQ ID NO: 952 - DNA, 20 bp, Artificial sequence
  Synthetic Oligonucleotide
atttaactttgctgtattat

SEQ ID NO: 953 - DNA, 20 bp, Artificial sequence
  Synthetic Oligonucleotide
atcaatgctaaatgaaatca

SEQ ID NO: 954 - DNA, 20 bp, Artificial sequence
  Synthetic Oligonucleotide
tattttctggagattatttt

SEQ ID NO: 955 - DNA, 20 bp, Artificial sequence
  Synthetic Oligonucleotide
aaaatgaatattggcaattc

SEQ ID NO: 956 - DNA, 20 bp, Artificial sequence
  Synthetic Oligonucleotide
aatgcctagaatcaataaaa

SEQ ID NO: 957 - DNA, 20 bp, Artificial sequence
  Synthetic Oligonucleotide
gtaaatatttgtagattagc

SEQ ID NO: 958 - DNA, 20 bp, Artificial sequence
  Synthetic Oligonucleotide
acaaatgtgtaattgtttga

SEQ ID NO: 959 - DNA, 20 bp, Artificial sequence
  Synthetic Oligonucleotide
tactaacaaatgtgtaattg

SEQ ID NO: 960 - DNA, 20 bp, Artificial sequence
  Synthetic Oligonucleotide
tgataagtatatttaagaac

SEQ ID NO: 961 - DNA, 20 bp, Artificial sequence
  Synthetic Oligonucleotide
ttaacttccaattaattgat

SEQ ID NO: 962 - DNA, 20 bp, Artificial sequence
  Synthetic Oligonucleotide
tctgttattttatcttgctt

SEQ ID NO: 963 - DNA, 20 bp, Artificial sequence
  Synthetic Oligonucleotide
atcacaatcctttttattaa

SEQ ID NO: 964 - DNA, 20 bp, Artificial sequence
  Synthetic Oligonucleotide
agagacttgagtaataataa

SEQ ID NO: 965 - DNA, 20 bp, Artificial sequence
  Synthetic Oligonucleotide
aacaaaatgaaacatgtcct

SEQ ID NO: 966 - DNA, 20 bp, Artificial sequence
  Synthetic Oligonucleotide
gattttcaatttcaagcaac

SEQ ID NO: 967 - DNA, 20 bp, Artificial sequence
  Synthetic Oligonucleotide
agcttaattgtgaacatttt

SEQ ID NO: 968 - DNA, 20 bp, Artificial sequence
  Synthetic Oligonucleotide
gaaggagcttaattgtgaac

SEQ ID NO: 969 - DNA, 20 bp, Artificial sequence
  Synthetic Oligonucleotide
caataaaaagaaggagctta

SEQ ID NO: 970 - DNA, 20 bp, Artificial sequence
  Synthetic Oligonucleotide
gaacaataaaaagaaggagc

SEQ ID NO: 971 - DNA, 20 bp, Artificial sequence
  Synthetic Oligonucleotide
ctggaggaaataactagagg

SEQ ID NO: 972 - DNA, 20 bp, Artificial sequence
  Synthetic Oligonucleotide
attctggaggaaataactag

SEQ ID NO: 973 - DNA, 20 bp, Artificial sequence
  Synthetic Oligonucleotide
tcaaatgatgaattgtcttg

SEQ ID NO: 974 - DNA, 20 bp, Artificial sequence
  Synthetic Oligonucleotide
ttgattttggctctggagat

SEQ ID NO: 975 - DNA, 20 bp, Artificial sequence
  Synthetic Oligonucleotide
gcaaatcttgattttggctc

SEQ ID NO: 976 - DNA, 20 bp, Artificial sequence
  Synthetic Oligonucleotide
atagcaaatcttgattttgg

SEQ ID NO: 977 - DNA, 20 bp, Artificial sequence
  Synthetic Oligonucleotide
cgtctaacatagcaaatctt

SEQ ID NO: 978 - DNA, 20 bp, Artificial sequence
  Synthetic Oligonucleotide
tggctaaaatttttacatcg

SEQ ID NO: 979 - DNA, 20 bp, Artificial sequence
  Synthetic Oligonucleotide
ccattggctaaaatttttac

SEQ ID NO: 980 - DNA, 20 bp, Artificial sequence
  Synthetic Oligonucleotide
aggaggccattggctaaaat

SEQ ID NO: 981 - DNA, 20 bp, Artificial sequence
  Synthetic Oligonucleotide
tgaaggaggccattggctaa

SEQ ID NO: 982 - DNA, 20 bp, Artificial sequence
  Synthetic Oligonucleotide
gtcccaactgaaggaggcca

SEQ ID NO: 983 - DNA, 20 bp, Artificial sequence
  Synthetic Oligonucleotide
ccatgtcccaactgaaggag

SEQ ID NO: 984 - DNA, 20 bp, Artificial sequence
  Synthetic Oligonucleotide
agaccatgtcccaactgaag

SEQ ID NO: 985 - DNA, 20 bp, Artificial sequence
  Synthetic Oligonucleotide
tttaagaccatgtcccaact

SEQ ID NO: 986 - DNA, 20 bp, Artificial sequence
  Synthetic Oligonucleotide
gtctttaagaccatgtccca

SEQ ID NO: 987 - DNA, 20 bp, Artificial sequence
  Synthetic Oligonucleotide
ggacaaagtctttaagacca

SEQ ID NO: 988 - DNA, 20 bp, Artificial sequence
  Synthetic Oligonucleotide
tcttatggacaaagtcttta

SEQ ID NO: 989 - DNA, 20 bp, Artificial sequence
  Synthetic Oligonucleotide
tatgtcattaatttggccct

SEQ ID NO: 990 - DNA, 20 bp, Artificial sequence
  Synthetic Oligonucleotide
gatcaaatatgttgagtttt

SEQ ID NO: 991 - DNA, 20 bp, Artificial sequence
  Synthetic Oligonucleotide
gactgatcaaatatgttgag

SEQ ID NO: 992 - DNA, 20 bp, Artificial sequence
  Synthetic Oligonucleotide
tcttctttgatttcactggt

SEQ ID NO: 993 - DNA, 20 bp, Artificial sequence
  Synthetic Oligonucleotide
cttctcagttccttttcttc

SEQ ID NO: 994 - DNA, 20 bp, Artificial sequence
  Synthetic Oligonucleotide
gttcttctcagttccttttc

SEQ ID NO: 995 - DNA, 20 bp, Artificial sequence
  Synthetic Oligonucleotide
tgtagttcttctcagttcct

SEQ ID NO: 996 - DNA, 20 bp, Artificial sequence
  Synthetic Oligonucleotide
tatatgtagttcttctcagt

SEQ ID NO: 997 - DNA, 20 bp, Artificial sequence
  Synthetic Oligonucleotide
gtttatatgtagttcttctc

SEQ ID NO: 998 - DNA, 20 bp, Artificial sequence
  Synthetic Oligonucleotide
tgtagtttatatgtagttct

SEQ ID NO: 999 - DNA, 20 bp, Artificial sequence
  Synthetic Oligonucleotide
gacttgtagtttatatgtag

SEQ ID NO: 1000 - DNA, 20 bp, Artificial sequence
  Synthetic Oligonucleotide
tcatttttgacttgtagttt

SEQ ID NO: 1001 - DNA, 20 bp, Artificial sequence
  Synthetic Oligonucleotide
cctcttcatttttgacttgt

SEQ ID NO: 1002 - DNA, 20 bp, Artificial sequence
  Synthetic Oligonucleotide
tctttacctcttcatttttg

SEQ ID NO: 1003 - DNA, 20 bp, Artificial sequence
  Synthetic Oligonucleotide
catattctttacctcttcat

SEQ ID NO: 1004 - DNA, 20 bp, Artificial sequence
  Synthetic Oligonucleotide
gtgacatattctttacctct

SEQ ID NO: 1005 - DNA, 20 bp, Artificial sequence
  Synthetic Oligonucleotide
gagttcaagtgacatattct

SEQ ID NO: 1006 - DNA, 20 bp, Artificial sequence
  Synthetic Oligonucleotide
tgagttgagttcaagtgaca

SEQ ID NO: 1007 - DNA, 20 bp, Artificial sequence
  Synthetic Oligonucleotide
agttttgagttgagttcaag

SEQ ID NO: 1008 - DNA, 20 bp, Artificial sequence
  Synthetic Oligonucleotide
tcaagttttgagttgagttc

SEQ ID NO: 1009 - DNA, 20 bp, Artificial sequence
  Synthetic Oligonucleotide
ggaggctttcaagttttgag

SEQ ID NO: 1010 - DNA, 20 bp, Artificial sequence
  Synthetic Oligonucleotide
tttcttctaggaggctttca

SEQ ID NO: 1011 - DNA, 20 bp, Artificial sequence
  Synthetic Oligonucleotide
attttttcttctaggaggct

SEQ ID NO: 1012 - DNA, 20 bp, Artificial sequence
  Synthetic Oligonucleotide
gtagaattttttcttctagg

SEQ ID NO: 1013 - DNA, 20 bp, Artificial sequence
  Synthetic Oligonucleotide
gctcttctaaatatttcact

SEQ ID NO: 1014 - DNA, 20 bp, Artificial sequence
  Synthetic Oligonucleotide
agttagttagttgctcttct

SEQ ID NO: 1015 - DNA, 20 bp, Artificial sequence
  Synthetic Oligonucleotide
caggttgattttgaattaag

SEQ ID NO: 1016 - DNA, 20 bp, Artificial sequence
  Synthetic Oligonucleotide
tttcaggttgattttgaatt

SEQ ID NO: 1017 - DNA, 20 bp, Artificial sequence
  Synthetic Oligonucleotide
ggagtttcaggttgattttg

SEQ ID NO: 1018 - DNA, 20 bp, Artificial sequence
  Synthetic Oligonucleotide
gttctggagtttcaggttga

SEQ ID NO: 1019 - DNA, 20 bp, Artificial sequence
  Synthetic Oligonucleotide
ttaagtgaagttacttctgg

SEQ ID NO: 1020 - DNA, 20 bp, Artificial sequence
  Synthetic Oligonucleotide
tgctattatcttgtttttct

SEQ ID NO: 1021 - DNA, 20 bp, Artificial sequence
  Synthetic Oligonucleotide
ggtctttgatgctattatct

SEQ ID NO: 1022 - DNA, 20 bp, Artificial sequence
  Synthetic Oligonucleotide
gaaggtctttgatgctatta

SEQ ID NO: 1023 - DNA, 20 bp, Artificial sequence
  Synthetic Oligonucleotide
ctggagaaggtctttgatgc

SEQ ID NO: 1024 - DNA, 20 bp, Artificial sequence
  Synthetic Oligonucleotide
ctgagctgattttctatttc

SEQ ID NO: 1025 - DNA, 20 bp, Artificial sequence
  Synthetic Oligonucleotide
atttctgtgggttcttgaat

SEQ ID NO: 1026 - DNA, 20 bp, Artificial sequence
  Synthetic Oligonucleotide
gagaaatttctgtgggttct

SEQ ID NO: 1027 - DNA, 20 bp, Artificial sequence
  Synthetic Oligonucleotide
gatagagaaatttctgtggg

SEQ ID NO: 1028 - DNA, 20 bp, Artificial sequence
  Synthetic Oligonucleotide
cttggaagatagagaaattt

SEQ ID NO: 1029 - DNA, 20 bp, Artificial sequence
  Synthetic Oligonucleotide
gtgctcttggcttggaagat

SEQ ID NO: 1030 - DNA, 20 bp, Artificial sequence
  Synthetic Oligonucleotide
cttggtgctcttggcttgga

SEQ ID NO: 1031 - DNA, 20 bp, Artificial sequence
  Synthetic Oligonucleotide
gggagtagttcttggtgctc

SEQ ID NO: 1032 - DNA, 20 bp, Artificial sequence
  Synthetic Oligonucleotide
ctgaagaaagggagtagttc

SEQ ID NO: 1033 - DNA, 20 bp, Artificial sequence
  Synthetic Oligonucleotide
atcatgttttacatttctta

SEQ ID NO: 1034 - DNA, 20 bp, Artificial sequence
  Synthetic Oligonucleotide
gccatcatgttttacatttc

SEQ ID NO: 1035 - DNA, 20 bp, Artificial sequence
  Synthetic Oligonucleotide
gaatgccatcatgttttaca

SEQ ID NO: 1036 - DNA, 20 bp, Artificial sequence
  Synthetic Oligonucleotide
caggaatgccatcatgtttt

SEQ ID NO: 1037 - DNA, 20 bp, Artificial sequence
  Synthetic Oligonucleotide
aaagtcaatgtgacttagta

SEQ ID NO: 1038 - DNA, 20 bp, Artificial sequence
  Synthetic Oligonucleotide
aaggtatagtgatacctcat

SEQ ID NO: 1039 - DNA, 20 bp, Artificial sequence
  Synthetic Oligonucleotide
actgttttcttctggaagca

SEQ ID NO: 1040 - DNA, 20 bp, Artificial sequence
  Synthetic Oligonucleotide
aaataaggtatagtgatacc

SEQ ID NO: 1041 - DNA, 20 bp, Artificial sequence
  Synthetic Oligonucleotide
acaaataaggtatagtgata

SEQ ID NO: 1042 - DNA, 20 bp, Artificial sequence
  Synthetic Oligonucleotide
taacaaataaggtatagtga

SEQ ID NO: 1043 - DNA, 20 bp, Artificial sequence
  Synthetic Oligonucleotide
tttaacaaataaggtatagt

SEQ ID NO: 1044 - DNA, 20 bp, Artificial sequence
  Synthetic Oligonucleotide
atatattttaacaaataagg

SEQ ID NO: 1045 - DNA, 20 bp, Artificial sequence
  Synthetic Oligonucleotide
cagtatatattttaacaaat

SEQ ID NO: 1046 - DNA, 20 bp, Artificial sequence
  Synthetic Oligonucleotide
tacagtatatattttaacaa

SEQ ID NO: 1047 - DNA, 20 bp, Artificial sequence
  Synthetic Oligonucleotide
tatacagtatatattttaac

SEQ ID NO: 1048 - DNA, 20 bp, Artificial sequence
  Synthetic Oligonucleotide
atagtattaagtgttaaaat

SEQ ID NO: 1049 - DNA, 20 bp, Artificial sequence
  Synthetic Oligonucleotide
tcatagtattaagtgttaaa

SEQ ID NO: 1050 - DNA, 20 bp, Artificial sequence
  Synthetic Oligonucleotide
gttttcatagtattaagtgt

SEQ ID NO: 1051 - DNA, 20 bp, Artificial sequence
  Synthetic Oligonucleotide
attatttgttttcatagtat

SEQ ID NO: 1052 - DNA, 20 bp, Artificial sequence
  Synthetic Oligonucleotide
ctttacaattatttgttttc

SEQ ID NO: 1053 - DNA, 20 bp, Artificial sequence
  Synthetic Oligonucleotide
attcctttacaattatttgt

SEQ ID NO: 1054 - DNA, 20 bp, Artificial sequence
  Synthetic Oligonucleotide
agattcctttacaattattt

SEQ ID NO: 1055 - DNA, 20 bp, Artificial sequence
  Synthetic Oligonucleotide
caagattcctttacaattat

SEQ ID NO: 1056 - DNA, 20 bp, Artificial sequence
  Synthetic Oligonucleotide
gacaagattcctttacaatt

SEQ ID NO: 1057 - DNA, 20 bp, Artificial sequence
  Synthetic Oligonucleotide
ctgacaagattcctttacaa

SEQ ID NO: 1058 - DNA, 20 bp, Artificial sequence
  Synthetic Oligonucleotide
aatctgacaagattccttta

SEQ ID NO: 1059 - DNA, 20 bp, Artificial sequence
  Synthetic Oligonucleotide
gtaatctgacaagattcctt

SEQ ID NO: 1060 - DNA, 20 bp, Artificial sequence
  Synthetic Oligonucleotide
ctgtaatctgacaagattcc

SEQ ID NO: 1061 - DNA, 20 bp, Artificial sequence
  Synthetic Oligonucleotide
tactgtaatctgacaagatt

SEQ ID NO: 1062 - DNA, 20 bp, Artificial sequence
  Synthetic Oligonucleotide
cttactgtaatctgacaaga

SEQ ID NO: 1063 - DNA, 20 bp, Artificial sequence
  Synthetic Oligonucleotide
ttcttactgtaatctgacaa

SEQ ID NO: 1064 - DNA, 20 bp, Artificial sequence
  Synthetic Oligonucleotide
cattcttactgtaatctgac

SEQ ID NO: 1065 - DNA, 20 bp, Artificial sequence
  Synthetic Oligonucleotide
ttcattcttactgtaatctg

SEQ ID NO: 1066 - DNA, 20 bp, Artificial sequence
  Synthetic Oligonucleotide
tgttcattcttactgtaatc

SEQ ID NO: 1067 - DNA, 20 bp, Artificial sequence
  Synthetic Oligonucleotide
tatgttcattcttactgtaa

SEQ ID NO: 1068 - DNA, 20 bp, Artificial sequence
  Synthetic Oligonucleotide
aatatgttcattcttactgt

SEQ ID NO: 1069 - DNA, 20 bp, Artificial sequence
  Synthetic Oligonucleotide
acaaatatgttcattcttac

SEQ ID NO: 1070 - DNA, 20 bp, Artificial sequence
  Synthetic Oligonucleotide
cgatgccacaaatatgttca

SEQ ID NO: 1071 - DNA, 20 bp, Artificial sequence
  Synthetic Oligonucleotide
ctcgatgccacaaatatgtt

SEQ ID NO: 1072 - DNA, 20 bp, Artificial sequence
  Synthetic Oligonucleotide
aactcgatgccacaaatatg

SEQ ID NO: 1073 - DNA, 20 bp, Artificial sequence
  Synthetic Oligonucleotide
ttaactcgatgccacaaata

SEQ ID NO: 1074 - DNA, 20 bp, Artificial sequence
  Synthetic Oligonucleotide
ctttaactcgatgccacaaa

SEQ ID NO: 1075 - DNA, 20 bp, Artificial sequence
  Synthetic Oligonucleotide
aactttaactcgatgccaca

SEQ ID NO: 1076 - DNA, 20 bp, Artificial sequence
  Synthetic Oligonucleotide
aatataaactttaactcgat

SEQ ID NO: 1077 - DNA, 20 bp, Artificial sequence
  Synthetic Oligonucleotide
gaaatataaactttaactcg

SEQ ID NO: 1078 - DNA, 20 bp, Artificial sequence
  Synthetic Oligonucleotide
gggaaatataaactttaact

SEQ ID NO: 1079 - DNA, 20 bp, Artificial sequence
  Synthetic Oligonucleotide
gaatcacagcatatttaggg

SEQ ID NO: 1080 - DNA, 20 bp, Artificial sequence
  Synthetic Oligonucleotide
tagaatcacagcatatttag

SEQ ID NO: 1081 - DNA, 20 bp, Artificial sequence
  Synthetic Oligonucleotide
gtattagaatcacagcatat

SEQ ID NO: 1082 - DNA, 20 bp, Artificial sequence
  Synthetic Oligonucleotide
atgtattagaatcacagcat

SEQ ID NO: 1083 - DNA, 20 bp, Artificial sequence
  Synthetic Oligonucleotide
gaatgtattagaatcacagc

SEQ ID NO: 1084 - DNA, 20 bp, Artificial sequence
  Synthetic Oligonucleotide
acgaatgtattagaatcaca

SEQ ID NO: 1085 - DNA, 20 bp, Artificial sequence
  Synthetic Oligonucleotide
acacgaatgtattagaatca

SEQ ID NO: 1086 - DNA, 20 bp, Artificial sequence
  Synthetic Oligonucleotide
ctacacgaatgtattagaat

SEQ ID NO: 1087 - DNA, 20 bp, Artificial sequence
  Synthetic Oligonucleotide
acctacacgaatgtattaga

SEQ ID NO: 1088 - DNA, 20 bp, Artificial sequence
  Synthetic Oligonucleotide
aaacctacacgaatgtatta

SEQ ID NO: 1089 - DNA, 20 bp, Artificial sequence
  Synthetic Oligonucleotide
gaaaacctacacgaatgtat

SEQ ID NO: 1090 - DNA, 20 bp, Artificial sequence
  Synthetic Oligonucleotide
ttgaaaacctacacgaatgt

SEQ ID NO: 1091 - DNA, 20 bp, Artificial sequence
  Synthetic Oligonucleotide
acttgaaaacctacacgaat

SEQ ID NO: 1092 - DNA, 20 bp, Artificial sequence
  Synthetic Oligonucleotide
ctacttgaaaacctacacga

SEQ ID NO: 1093 - DNA, 20 bp, Artificial sequence
  Synthetic Oligonucleotide
tatttctacttgaaaaccta

SEQ ID NO: 1094 - DNA, 20 bp, Artificial sequence
  Synthetic Oligonucleotide
tttatttctacttgaaaacc

SEQ ID NO: 1095 - DNA, 20 bp, Artificial sequence
  Synthetic Oligonucleotide
ggtttatttctacttgaaaa

SEQ ID NO: 1096 - DNA, 20 bp, Artificial sequence
  Synthetic Oligonucleotide
gaggtttatttctacttgaa

SEQ ID NO: 1097 - DNA, 20 bp, Artificial sequence
  Synthetic Oligonucleotide
ttacgaggtttatttctact

SEQ ID NO: 1098 - DNA, 20 bp, Artificial sequence
  Synthetic Oligonucleotide
tgttacgaggtttatttcta

SEQ ID NO: 1099 - DNA, 20 bp, Artificial sequence
  Synthetic Oligonucleotide
cttgttacgaggtttatttc

SEQ ID NO: 1100 - DNA, 20 bp, Artificial sequence
  Synthetic Oligonucleotide
aacttgttacgaggtttatt

SEQ ID NO: 1101 - DNA, 20 bp, Artificial sequence
  Synthetic Oligonucleotide
gtaacttgttacgaggttta

SEQ ID NO: 1102 - DNA, 20 bp, Artificial sequence
  Synthetic Oligonucleotide
cagtaacttgttacgaggtt

SEQ ID NO: 1103 - DNA, 20 bp, Artificial sequence
  Synthetic Oligonucleotide
ttcagtaacttgttacgagg

SEQ ID NO: 1104 - DNA, 20 bp, Artificial sequence
  Synthetic Oligonucleotide
cgttcagtaacttgttacga

SEQ ID NO: 1105 - DNA, 20 bp, Artificial sequence
  Synthetic Oligonucleotide
cttgtcaggctgtttaaacg

SEQ ID NO: 1106 - DNA, 20 bp, Artificial sequence
  Synthetic Oligonucleotide
tgcttgtcaggctgtttaaa

SEQ ID NO: 1107 - DNA, 20 bp, Artificial sequence
  Synthetic Oligonucleotide
tatacatgcttgtcaggctg

SEQ ID NO: 1108 - DNA, 20 bp, Artificial sequence
  Synthetic Oligonucleotide
tatatacatgcttgtcaggc

SEQ ID NO: 1109 - DNA, 20 bp, Artificial sequence
  Synthetic Oligonucleotide
catatatacatgcttgtcag

SEQ ID NO: 1110 - DNA, 20 bp, Artificial sequence
  Synthetic Oligonucleotide
tggaactgttttcttctgga

SEQ ID NO: 1111 - DNA, 20 bp, Artificial sequence
  Synthetic Oligonucleotide
cgtggaactgttttcttctg

SEQ ID NO: 1112 - DNA, 20 bp, Artificial sequence
  Synthetic Oligonucleotide
tcttgattttcaatttcaag

SEQ ID NO: 1113 - DNA, 20 bp, Artificial sequence
  Synthetic Oligonucleotide
ttttatcttgattttcaatt

SEQ ID NO: 1114 - DNA, 20 bp, Artificial sequence
  Synthetic Oligonucleotide
catttttatcttgattttca

SEQ ID NO: 1115 - DNA, 20 bp, Artificial sequence
  Synthetic Oligonucleotide
attgtgaacatttttatctt

SEQ ID NO: 1116 - DNA, 20 bp, Artificial sequence
  Synthetic Oligonucleotide
taattgtgaacatttttatc

SEQ ID NO: 1117 - DNA, 20 bp, Artificial sequence
  Synthetic Oligonucleotide
aagaaggagcttaattgtga

SEQ ID NO: 1118 - DNA, 20 bp, Artificial sequence
  Synthetic Oligonucleotide
aaaagaaggagcttaattgt

SEQ ID NO: 1119 - DNA, 20 bp, Artificial sequence
  Synthetic Oligonucleotide
taaaaagaaggagcttaatt

SEQ ID NO: 1120 - DNA, 20 bp, Artificial sequence
  Synthetic Oligonucleotide
taactagaggaacaataaaa

SEQ ID NO: 1121 - DNA, 20 bp, Artificial sequence
  Synthetic Oligonucleotide
aataactagaggaacaataa

SEQ ID NO: 1122 - DNA, 20 bp, Artificial sequence
  Synthetic Oligonucleotide
gaaataactagaggaacaat

SEQ ID NO: 1123 - DNA, 20 bp, Artificial sequence
  Synthetic Oligonucleotide
aggaaataactagaggaaca

SEQ ID NO: 1124 - DNA, 20 bp, Artificial sequence
  Synthetic Oligonucleotide
ggaggaaataactagaggaa

SEQ ID NO: 1125 - DNA, 20 bp, Artificial sequence
  Synthetic Oligonucleotide
caattctggaggaaataact

SEQ ID NO: 1126 - DNA, 20 bp, Artificial sequence
  Synthetic Oligonucleotide
atcaattctggaggaaataa

SEQ ID NO: 1127 - DNA, 20 bp, Artificial sequence
  Synthetic Oligonucleotide
cttgatcaattctggaggaa

SEQ ID NO: 1128 - DNA, 20 bp, Artificial sequence
  Synthetic Oligonucleotide
gtcttgatcaattctggagg

SEQ ID NO: 1129 - DNA, 20 bp, Artificial sequence
  Synthetic Oligonucleotide
ttgtcttgatcaattctgga

SEQ ID NO: 1130 - DNA, 20 bp, Artificial sequence
  Synthetic Oligonucleotide
aattgtcttgatcaattctg

SEQ ID NO: 1131 - DNA, 20 bp, Artificial sequence
  Synthetic Oligonucleotide
tgaattgtcttgatcaattc

SEQ ID NO: 1132 - DNA, 20 bp, Artificial sequence
  Synthetic Oligonucleotide
gatgaattgtcttgatcaat

SEQ ID NO: 1133 - DNA, 20 bp, Artificial sequence
  Synthetic Oligonucleotide
atgatgaattgtcttgatca

SEQ ID NO: 1134 - DNA, 20 bp, Artificial sequence
  Synthetic Oligonucleotide
aaatgatgaattgtcttgat

SEQ ID NO: 1135 - DNA, 20 bp, Artificial sequence
  Synthetic Oligonucleotide
aatcaaatgatgaattgtct

SEQ ID NO: 1136 - DNA, 20 bp, Artificial sequence
  Synthetic Oligonucleotide
agaatcaaatgatgaattgt

SEQ ID NO: 1137 - DNA, 20 bp, Artificial sequence
  Synthetic Oligonucleotide
tagagaatcaaatgatgaat

SEQ ID NO: 1138 - DNA, 20 bp, Artificial sequence
  Synthetic Oligonucleotide
ctggagatagagaatcaaat

SEQ ID NO: 1139 - DNA, 20 bp, Artificial sequence
  Synthetic Oligonucleotide
ctctggagatagagaatcaa

SEQ ID NO: 1140 - DNA, 20 bp, Artificial sequence
  Synthetic Oligonucleotide
ttggctctggagatagagaa

SEQ ID NO: 1141 - DNA, 20 bp, Artificial sequence
  Synthetic Oligonucleotide
attttggctctggagataga

SEQ ID NO: 1142 - DNA, 20 bp, Artificial sequence
  Synthetic Oligonucleotide
aatcttgattttggctctgg

SEQ ID NO: 1143 - DNA, 20 bp, Artificial sequence
  Synthetic Oligonucleotide
acatagcaaatcttgatttt

SEQ ID NO: 1144 - DNA, 20 bp, Artificial sequence
  Synthetic Oligonucleotide
taacatagcaaatcttgatt

SEQ ID NO: 1145 - DNA, 20 bp, Artificial sequence
  Synthetic Oligonucleotide
tctaacatagcaaatcttga

SEQ ID NO: 1146 - DNA, 20 bp, Artificial sequence
  Synthetic Oligonucleotide
attggctaaaatttttacat

SEQ ID NO: 1147 - DNA, 20 bp, Artificial sequence
  Synthetic Oligonucleotide
ggccattggctaaaattttt

SEQ ID NO: 1148 - DNA, 20 bp, Artificial sequence
  Synthetic Oligonucleotide
gaggccattggctaaaattt

SEQ ID NO: 1149 - DNA, 20 bp, Artificial sequence
  Synthetic Oligonucleotide
actgaaggaggccattggct

SEQ ID NO: 1150 - DNA, 20 bp, Artificial sequence
  Synthetic Oligonucleotide
caactgaaggaggccattgg

SEQ ID NO: 1151 - DNA, 20 bp, Artificial sequence
  Synthetic Oligonucleotide
cccaactgaaggaggccatt

SEQ ID NO: 1152 - DNA, 20 bp, Artificial sequence
  Synthetic Oligonucleotide
atgtcccaactgaaggaggc

SEQ ID NO: 1153 - DNA, 20 bp, Artificial sequence
  Synthetic Oligonucleotide
taagaccatgtcccaactga

SEQ ID NO: 1154 - DNA, 20 bp, Artificial sequence
  Synthetic Oligonucleotide
aagtctttaagaccatgtcc

SEQ ID NO: 1155 - DNA, 20 bp, Artificial sequence
  Synthetic Oligonucleotide
caaagtctttaagaccatgt

SEQ ID NO: 1156 - DNA, 20 bp, Artificial sequence
  Synthetic Oligonucleotide
tatggacaaagtctttaaga

SEQ ID NO: 1157 - DNA, 20 bp, Artificial sequence
  Synthetic Oligonucleotide
cgtcttatggacaaagtctt

SEQ ID NO: 1158 - DNA, 20 bp, Artificial sequence
  Synthetic Oligonucleotide
aatatgtcattaatttggcc

SEQ ID NO: 1159 - DNA, 20 bp, Artificial sequence
  Synthetic Oligonucleotide
gaaatatgtcattaatttgg

SEQ ID NO: 1160 - DNA, 20 bp, Artificial sequence
  Synthetic Oligonucleotide
tttgaaatatgtcattaatt

SEQ ID NO: 1161 - DNA, 20 bp, Artificial sequence
  Synthetic Oligonucleotide
agtttttgaaatatgtcatt

SEQ ID NO: 1162 - DNA, 20 bp, Artificial sequence
  Synthetic Oligonucleotide
tgagtttttgaaatatgtca

SEQ ID NO: 1163 - DNA, 20 bp, Artificial sequence
  Synthetic Oligonucleotide
caaatatgttgagtttttga

SEQ ID NO: 1164 - DNA, 20 bp, Artificial sequence
  Synthetic Oligonucleotide
ctgatcaaatatgttgagtt

SEQ ID NO: 1165 - DNA, 20 bp, Artificial sequence
  Synthetic Oligonucleotide
aagactgatcaaatatgttg

SEQ ID NO: 1166 - DNA, 20 bp, Artificial sequence
  Synthetic Oligonucleotide
taaaaagactgatcaaatat

SEQ ID NO: 1167 - DNA, 20 bp, Artificial sequence
  Synthetic Oligonucleotide
cataaaaagactgatcaaat

SEQ ID NO: 1168 - DNA, 20 bp, Artificial sequence
  Synthetic Oligonucleotide
atcataaaaagactgatcaa

SEQ ID NO: 1169 - DNA, 20 bp, Artificial sequence
  Synthetic Oligonucleotide
tagatcataaaaagactgat

SEQ ID NO: 1170 - DNA, 20 bp, Artificial sequence
  Synthetic Oligonucleotide
gatagatcataaaaagactg

SEQ ID NO: 1171 - DNA, 20 bp, Artificial sequence
  Synthetic Oligonucleotide
gcgatagatcataaaaagac

SEQ ID NO: 1172 - DNA, 20 bp, Artificial sequence
  Synthetic Oligonucleotide
cagcgatagatcataaaaag

SEQ ID NO: 1173 - DNA, 20 bp, Artificial sequence
  Synthetic Oligonucleotide
tgcagcgatagatcataaaa

SEQ ID NO: 1174 - DNA, 20 bp, Artificial sequence
  Synthetic Oligonucleotide
tttgcagcgatagatcataa

SEQ ID NO: 1175 - DNA, 20 bp, Artificial sequence
  Synthetic Oligonucleotide
ggtttgcagcgatagatcat

SEQ ID NO: 1176 - DNA, 20 bp, Artificial sequence
  Synthetic Oligonucleotide
ctggtttgcagcgatagatc

SEQ ID NO: 1177 - DNA, 20 bp, Artificial sequence
  Synthetic Oligonucleotide
cactggtttgcagcgataga

SEQ ID NO: 1178 - DNA, 20 bp, Artificial sequence
  Synthetic Oligonucleotide
atttcactggtttgcagcga

SEQ ID NO: 1179 - DNA, 20 bp, Artificial sequence
  Synthetic Oligonucleotide
ttgatttcactggtttgcag

SEQ ID NO: 1180 - DNA, 20 bp, Artificial sequence
  Synthetic Oligonucleotide
cttcttctttgatttcactg

SEQ ID NO: 1181 - DNA, 20 bp, Artificial sequence
  Synthetic Oligonucleotide
gttccttttcttcttctttg

SEQ ID NO: 1182 - DNA, 20 bp, Artificial sequence
  Synthetic Oligonucleotide
ttgtatgttcacctctgtta

SEQ ID NO: 1183 - DNA, 20 bp, Artificial sequence
  Synthetic Oligonucleotide
cttgtatgttcacctctgtt

SEQ ID NO: 1184 - DNA, 20 bp, Artificial sequence
  Synthetic Oligonucleotide
gccacttgtatgttcacctc

SEQ ID NO: 1185 - DNA, 20 bp, Artificial sequence
  Synthetic Oligonucleotide
tgccacttgtatgttcacct

SEQ ID NO: 1186 - DNA, 20 bp, Artificial sequence
  Synthetic Oligonucleotide
atgccacttgtatgttcacc

SEQ ID NO: 1187 - DNA, 20 bp, Artificial sequence
  Synthetic Oligonucleotide
catgccacttgtatgttcac

SEQ ID NO: 1188 - DNA, 20 bp, Artificial sequence
  Synthetic Oligonucleotide
acatgccacttgtatgttca

SEQ ID NO: 1189 - DNA, 20 bp, Artificial sequence
  Synthetic Oligonucleotide
tacatgccacttgtatgttc

SEQ ID NO: 1190 - DNA, 20 bp, Artificial sequence
  Synthetic Oligonucleotide
gcatacatgccacttgtatg

SEQ ID NO: 1191 - DNA, 20 bp, Artificial sequence
  Synthetic Oligonucleotide
ggcatacatgccacttgtat

SEQ ID NO: 1192 - DNA, 20 bp, Artificial sequence
  Synthetic Oligonucleotide
tggcatacatgccacttgta

SEQ ID NO: 1193 - DNA, 20 bp, Artificial sequence
  Synthetic Oligonucleotide
atggcatacatgccacttgt

SEQ ID NO: 1194 - DNA, 20 bp, Artificial sequence
  Synthetic Oligonucleotide
tctgatggcatacatgccac

SEQ ID NO: 1195 - DNA, 20 bp, Artificial sequence
  Synthetic Oligonucleotide
gtctgatggcatacatgcca

SEQ ID NO: 1196 - DNA, 20 bp, Artificial sequence
  Synthetic Oligonucleotide
gggtctgatggcatacatgc

SEQ ID NO: 1197 - DNA, 20 bp, Artificial sequence
  Synthetic Oligonucleotide
tgggtctgatggcatacatg

SEQ ID NO: 1198 - DNA, 20 bp, Artificial sequence
  Synthetic Oligonucleotide
ctgggtctgatggcatacat

SEQ ID NO: 1199 - DNA, 20 bp, Artificial sequence
  Synthetic Oligonucleotide
gagagttgctgggtctgatg

SEQ ID NO: 1200 - DNA, 20 bp, Artificial sequence
  Synthetic Oligonucleotide
tgagagttgctgggtctgat

SEQ ID NO: 1201 - DNA, 20 bp, Artificial sequence
  Synthetic Oligonucleotide
ttgagagttgctgggtctga

SEQ ID NO: 1202 - DNA, 20 bp, Artificial sequence
  Synthetic Oligonucleotide
cttgagagttgctgggtctg

SEQ ID NO: 1203 - DNA, 20 bp, Artificial sequence
  Synthetic Oligonucleotide
acttgagagttgctgggtct

SEQ ID NO: 1204 - DNA, 20 bp, Artificial sequence
  Synthetic Oligonucleotide
aacttgagagttgctgggtc

SEQ ID NO: 1205 - DNA, 20 bp, Artificial sequence
  Synthetic Oligonucleotide
gaaaaacttgagagttgctg

SEQ ID NO: 1206 - DNA, 20 bp, Artificial sequence
  Synthetic Oligonucleotide
tgaaaaacttgagagttgct

SEQ ID NO: 1207 - DNA, 20 bp, Artificial sequence
  Synthetic Oligonucleotide
atgaaaaacttgagagttgc

SEQ ID NO: 1208 - DNA, 20 bp, Artificial sequence
  Synthetic Oligonucleotide
catgaaaaacttgagagttg

SEQ ID NO: 1209 - DNA, 20 bp, Artificial sequence
  Synthetic Oligonucleotide
gtagacatgaaaaacttgag

SEQ ID NO: 1210 - DNA, 20 bp, Artificial sequence
  Synthetic Oligonucleotide
cagtagacatgaaaaacttg

SEQ ID NO: 1211 - DNA, 20 bp, Artificial sequence
  Synthetic Oligonucleotide
taacatcacagtagacatga

SEQ ID NO: 1212 - DNA, 20 bp, Artificial sequence
  Synthetic Oligonucleotide
ataacatcacagtagacatg

SEQ ID NO: 1213 - DNA, 20 bp, Artificial sequence
  Synthetic Oligonucleotide
tataacatcacagtagacat

SEQ ID NO: 1214 - DNA, 20 bp, Artificial sequence
  Synthetic Oligonucleotide
atataacatcacagtagaca

SEQ ID NO: 1215 - DNA, 20 bp, Artificial sequence
  Synthetic Oligonucleotide
gatataacatcacagtagac

SEQ ID NO: 1216 - DNA, 20 bp, Artificial sequence
  Synthetic Oligonucleotide
tgatataacatcacagtaga

SEQ ID NO: 1217 - DNA, 20 bp, Artificial sequence
  Synthetic Oligonucleotide
ctgatataacatcacagtag

SEQ ID NO: 1218 - DNA, 20 bp, Artificial sequence
  Synthetic Oligonucleotide
cctgatataacatcacagta

SEQ ID NO: 1219 - DNA, 20 bp, Artificial sequence
  Synthetic Oligonucleotide
acctgatataacatcacagt

SEQ ID NO: 1220 - DNA, 20 bp, Artificial sequence
  Synthetic Oligonucleotide
tacctgatataacatcacag

SEQ ID NO: 1221 - DNA, 20 bp, Artificial sequence
  Synthetic Oligonucleotide
ctacctgatataacatcaca

SEQ ID NO: 1222 - DNA, 20 bp, Artificial sequence
  Synthetic Oligonucleotide
actacctgatataacatcac

SEQ ID NO: 1223 - DNA, 20 bp, Artificial sequence
  Synthetic Oligonucleotide
gactacctgatataacatca

SEQ ID NO: 1224 - DNA, 20 bp, Artificial sequence
  Synthetic Oligonucleotide
ggactacctgatataacatc

SEQ ID NO: 1225 - DNA, 20 bp, Artificial sequence
  Synthetic Oligonucleotide
tggactacctgatataacat

SEQ ID NO: 1226 - DNA, 20 bp, Artificial sequence
  Synthetic Oligonucleotide
atggactacctgatataaca

SEQ ID NO: 1227 - DNA, 20 bp, Artificial sequence
  Synthetic Oligonucleotide
catggactacctgatataac

SEQ ID NO: 1228 - DNA, 20 bp, Artificial sequence
  Synthetic Oligonucleotide
ccatggactacctgatataa

SEQ ID NO: 1229 - DNA, 20 bp, Artificial sequence
  Synthetic Oligonucleotide
tccatggactacctgatata

SEQ ID NO: 1230 - DNA, 20 bp, Artificial sequence
  Synthetic Oligonucleotide
gtccatggactacctgatat

SEQ ID NO: 1231 - DNA, 20 bp, Artificial sequence
  Synthetic Oligonucleotide
tgtccatggactacctgata

SEQ ID NO: 1232 - DNA, 20 bp, Artificial sequence
  Synthetic Oligonucleotide
atgtccatggactacctgat

SEQ ID NO: 1233 - DNA, 20 bp, Artificial sequence
  Synthetic Oligonucleotide
aatgtccatggactacctga

SEQ ID NO: 1234 - DNA, 20 bp, Artificial sequence
  Synthetic Oligonucleotide
taatgtccatggactacctg

SEQ ID NO: 1235 - DNA, 20 bp, Artificial sequence
  Synthetic Oligonucleotide
ttaatgtccatggactacct

SEQ ID NO: 1236 - DNA, 20 bp, Artificial sequence
  Synthetic Oligonucleotide
attaatgtccatggactacc

SEQ ID NO: 1237 - DNA, 20 bp, Artificial sequence
  Synthetic Oligonucleotide
aattaatgtccatggactac

SEQ ID NO: 1238 - DNA, 20 bp, Artificial sequence
  Synthetic Oligonucleotide
gttgaattaatgtccatgga

SEQ ID NO: 1239 - DNA, 20 bp, Artificial sequence
  Synthetic Oligonucleotide
tgttgaattaatgtccatgg

SEQ ID NO: 1240 - DNA, 20 bp, Artificial sequence
  Synthetic Oligonucleotide
atgttgaattaatgtccatg

SEQ ID NO: 1241 - DNA, 20 bp, Artificial sequence
  Synthetic Oligonucleotide
gatgttgaattaatgtccat

SEQ ID NO: 1242 - DNA, 20 bp, Artificial sequence
  Synthetic Oligonucleotide
cgatgttgaattaatgtcca

SEQ ID NO: 1243 - DNA, 20 bp, Artificial sequence
  Synthetic Oligonucleotide
tcgatgttgaattaatgtcc

SEQ ID NO: 1244 - DNA, 20 bp, Artificial sequence
  Synthetic Oligonucleotide
ttcgatgttgaattaatgtc

SEQ ID NO: 1245 - DNA, 20 bp, Artificial sequence
  Synthetic Oligonucleotide
attcgatgttgaattaatgt

SEQ ID NO: 1246 - DNA, 20 bp, Artificial sequence
  Synthetic Oligonucleotide
tattcgatgttgaattaatg

SEQ ID NO: 1247 - DNA, 20 bp, Artificial sequence
  Synthetic Oligonucleotide
ctattcgatgttgaattaat

SEQ ID NO: 1248 - DNA, 20 bp, Artificial sequence
  Synthetic Oligonucleotide
atctattcgatgttgaatta

SEQ ID NO: 1249 - DNA, 20 bp, Artificial sequence
  Synthetic Oligonucleotide
catctattcgatgttgaatt

SEQ ID NO: 1250 - DNA, 20 bp, Artificial sequence
  Synthetic Oligonucleotide
ccatctattcgatgttgaat

SEQ ID NO: 1251 - DNA, 20 bp, Artificial sequence
  Synthetic Oligonucleotide
tccatctattcgatgttgaa

SEQ ID NO: 1252 - DNA, 20 bp, Artificial sequence
  Synthetic Oligonucleotide
atccatctattcgatgttga

SEQ ID NO: 1253 - DNA, 20 bp, Artificial sequence
  Synthetic Oligonucleotide
gatccatctattcgatgttg

SEQ ID NO: 1254 - DNA, 20 bp, Artificial sequence
  Synthetic Oligonucleotide
tgatccatctattcgatgtt

SEQ ID NO: 1255 - DNA, 20 bp, Artificial sequence
  Synthetic Oligonucleotide
gtgatccatctattcgatgt

SEQ ID NO: 1256 - DNA, 20 bp, Artificial sequence
  Synthetic Oligonucleotide
tgtgatccatctattcgatg

SEQ ID NO: 1257 - DNA, 20 bp, Artificial sequence
  Synthetic Oligonucleotide
ttgtgatccatctattcgat

SEQ ID NO: 1258 - DNA, 20 bp, Artificial sequence
  Synthetic Oligonucleotide
tttaggttgttttctccaca

SEQ ID NO: 1259 - DNA, 20 bp, Artificial sequence
  Synthetic Oligonucleotide
atttaggttgttttctccac

SEQ ID NO: 1260 - DNA, 20 bp, Artificial sequence
  Synthetic Oligonucleotide
taccatttaggttgttttct

SEQ ID NO: 1261 - DNA, 20 bp, Artificial sequence
  Synthetic Oligonucleotide
gttatatttaccatttaggt

SEQ ID NO: 1262 - DNA, 20 bp, Artificial sequence
  Synthetic Oligonucleotide
tgttatatttaccatttagg

SEQ ID NO: 1263 - DNA, 20 bp, Artificial sequence
  Synthetic Oligonucleotide
ttgttatatttaccatttag

SEQ ID NO: 1264 - DNA, 20 bp, Artificial sequence
  Synthetic Oligonucleotide
tttgttatatttaccattta

SEQ ID NO: 1265 - DNA, 20 bp, Artificial sequence
  Synthetic Oligonucleotide
tggtttgttatatttaccat

SEQ ID NO: 1266 - DNA, 20 bp, Artificial sequence
  Synthetic Oligonucleotide
ctcttggtttgttatattta

SEQ ID NO: 1267 - DNA, 20 bp, Artificial sequence
  Synthetic Oligonucleotide
gctcttggtttgttatattt

SEQ ID NO: 1268 - DNA, 20 bp, Artificial sequence
  Synthetic Oligonucleotide
tgctcttggtttgttatatt

SEQ ID NO: 1269 - DNA, 20 bp, Artificial sequence
  Synthetic Oligonucleotide
ttttgctcttggtttgttat

SEQ ID NO: 1270 - DNA, 20 bp, Artificial sequence
  Synthetic Oligonucleotide
attttgctcttggtttgtta

SEQ ID NO: 1271 - DNA, 20 bp, Artificial sequence
  Synthetic Oligonucleotide
gattttgctcttggtttgtt

SEQ ID NO: 1272 - DNA, 20 bp, Artificial sequence
  Synthetic Oligonucleotide
agattttgctcttggtttgt

SEQ ID NO: 1273 - DNA, 20 bp, Artificial sequence
  Synthetic Oligonucleotide
tagattttgctcttggtttg

SEQ ID NO: 1274 - DNA, 20 bp, Artificial sequence
  Synthetic Oligonucleotide
ctctctggcttagattttgc

SEQ ID NO: 1275 - DNA, 20 bp, Artificial sequence
  Synthetic Oligonucleotide
cctctctggcttagattttg

SEQ ID NO: 1276 - DNA, 20 bp, Artificial sequence
  Synthetic Oligonucleotide
tcctctctggcttagatttt

SEQ ID NO: 1277 - DNA, 20 bp, Artificial sequence
  Synthetic Oligonucleotide
cttctcctctctggcttaga

SEQ ID NO: 1278 - DNA, 20 bp, Artificial sequence
  Synthetic Oligonucleotide
tcttctcctctctggcttag

SEQ ID NO: 1279 - DNA, 20 bp, Artificial sequence
  Synthetic Oligonucleotide
ctcttctcctctctggctta

SEQ ID NO: 1280 - DNA, 20 bp, Artificial sequence
  Synthetic Oligonucleotide
taatcctcttctcctctctg

SEQ ID NO: 1281 - DNA, 20 bp, Artificial sequence
  Synthetic Oligonucleotide
ataatcctcttctcctctct

SEQ ID NO: 1282 - DNA, 20 bp, Artificial sequence
  Synthetic Oligonucleotide
gataatcctcttctcctctc

SEQ ID NO: 1283 - DNA, 20 bp, Artificial sequence
  Synthetic Oligonucleotide
agataatcctcttctcctct

SEQ ID NO: 1284 - DNA, 20 bp, Artificial sequence
  Synthetic Oligonucleotide
aagataatcctcttctcctc

SEQ ID NO: 1285 - DNA, 20 bp, Artificial sequence
  Synthetic Oligonucleotide
caagataatcctcttctcct

SEQ ID NO: 1286 - DNA, 20 bp, Artificial sequence
  Synthetic Oligonucleotide
ccaagataatcctcttctcc

SEQ ID NO: 1287 - DNA, 20 bp, Artificial sequence
  Synthetic Oligonucleotide
tccaagataatcctcttctc

SEQ ID NO: 1288 - DNA, 20 bp, Artificial sequence
  Synthetic Oligonucleotide
ttccaagataatcctcttct

SEQ ID NO: 1289 - DNA, 20 bp, Artificial sequence
  Synthetic Oligonucleotide
cttccaagataatcctcttc

SEQ ID NO: 1290 - DNA, 20 bp, Artificial sequence
  Synthetic Oligonucleotide
acttccaagataatcctctt

SEQ ID NO: 1291 - DNA, 20 bp, Artificial sequence
  Synthetic Oligonucleotide
gacttccaagataatcctct

SEQ ID NO: 1292 - DNA, 20 bp, Artificial sequence
  Synthetic Oligonucleotide
agacttccaagataatcctc

SEQ ID NO: 1293 - DNA, 20 bp, Artificial sequence
  Synthetic Oligonucleotide
gagacttccaagataatcct

SEQ ID NO: 1294 - DNA, 20 bp, Artificial sequence
  Synthetic Oligonucleotide
tgagacttccaagataatcc

SEQ ID NO: 1295 - DNA, 20 bp, Artificial sequence
  Synthetic Oligonucleotide
ttgagacttccaagataatc

SEQ ID NO: 1296 - DNA, 20 bp, Artificial sequence
  Synthetic Oligonucleotide
tttgagacttccaagataat

SEQ ID NO: 1297 - DNA, 20 bp, Artificial sequence
  Synthetic Oligonucleotide
ttttgagacttccaagataa

SEQ ID NO: 1298 - DNA, 20 bp, Artificial sequence
  Synthetic Oligonucleotide
attttgagacttccaagata

SEQ ID NO: 1299 - DNA, 20 bp, Artificial sequence
  Synthetic Oligonucleotide
ccattttgagacttccaaga

SEQ ID NO: 1300 - DNA, 20 bp, Artificial sequence
  Synthetic Oligonucleotide
cttccattttgagacttcca

SEQ ID NO: 1301 - DNA, 20 bp, Artificial sequence
  Synthetic Oligonucleotide
taaccttccattttgagact

SEQ ID NO: 1302 - DNA, 20 bp, Artificial sequence
  Synthetic Oligonucleotide
ataaccttccattttgagac

SEQ ID NO: 1303 - DNA, 20 bp, Artificial sequence
  Synthetic Oligonucleotide
tataaccttccattttgaga

SEQ ID NO: 1304 - DNA, 20 bp, Artificial sequence
  Synthetic Oligonucleotide
gtataaccttccattttgag

SEQ ID NO: 1305 - DNA, 20 bp, Artificial sequence
  Synthetic Oligonucleotide
gagtataaccttccattttg

SEQ ID NO: 1306 - DNA, 20 bp, Artificial sequence
  Synthetic Oligonucleotide
agagtataaccttccatttt

SEQ ID NO: 1307 - DNA, 20 bp, Artificial sequence
  Synthetic Oligonucleotide
ttatagagtataaccttcca

SEQ ID NO: 1308 - DNA, 20 bp, Artificial sequence
  Synthetic Oligonucleotide
gattttatagagtataacct

SEQ ID NO: 1309 - DNA, 20 bp, Artificial sequence
  Synthetic Oligonucleotide
tgattttatagagtataacc

SEQ ID NO: 1310 - DNA, 20 bp, Artificial sequence
  Synthetic Oligonucleotide
ttgattttatagagtataac

SEQ ID NO: 1311 - DNA, 20 bp, Artificial sequence
  Synthetic Oligonucleotide
gttgattttatagagtataa

SEQ ID NO: 1312 - DNA, 20 bp, Artificial sequence
  Synthetic Oligonucleotide
tttggttgattttatagagt

SEQ ID NO: 1313 - DNA, 20 bp, Artificial sequence
  Synthetic Oligonucleotide
ggatcaacattttggttgat

SEQ ID NO: 1314 - DNA, 20 bp, Artificial sequence
  Synthetic Oligonucleotide
tggatcaacattttggttga

SEQ ID NO: 1315 - DNA, 20 bp, Artificial sequence
  Synthetic Oligonucleotide
atggatcaacattttggttg

SEQ ID NO: 1316 - DNA, 20 bp, Artificial sequence
  Synthetic Oligonucleotide
aatctgttggatggatcaac

SEQ ID NO: 1317 - DNA, 20 bp, Artificial sequence
  Synthetic Oligonucleotide
gaatctgttggatggatcaa

SEQ ID NO: 1318 - DNA, 20 bp, Artificial sequence
  Synthetic Oligonucleotide
ttctgaatctgttggatgga

SEQ ID NO: 1319 - DNA, 20 bp, Artificial sequence
  Synthetic Oligonucleotide
tttctgaatctgttggatgg

SEQ ID NO: 1320 - DNA, 20 bp, Artificial sequence
  Synthetic Oligonucleotide
ctttctgaatctgttggatg

SEQ ID NO: 1321 - DNA, 20 bp, Artificial sequence
  Synthetic Oligonucleotide
aaagctttctgaatctgttg

SEQ ID NO: 1322 - DNA, 20 bp, Artificial sequence
  Synthetic Oligonucleotide
ttgcctcagttcattcaaag

SEQ ID NO: 1323 - DNA, 20 bp, Artificial sequence
  Synthetic Oligonucleotide
aaatttgcctcagttcattc

SEQ ID NO: 1324 - DNA, 20 bp, Artificial sequence
  Synthetic Oligonucleotide
cttttaaatttgcctcagtt

SEQ ID NO: 1325 - DNA, 20 bp, Artificial sequence
  Synthetic Oligonucleotide
tattgccttttaaatttgcc

SEQ ID NO: 1326 - DNA, 20 bp, Artificial sequence
  Synthetic Oligonucleotide
ttattgccttttaaatttgc

SEQ ID NO: 1327 - DNA, 20 bp, Artificial sequence
  Synthetic Oligonucleotide
ttaaattattgccttttaaa

SEQ ID NO: 1328 - DNA, 20 bp, Artificial sequence
  Synthetic Oligonucleotide
tttaaattattgccttttaa

SEQ ID NO: 1329 - DNA, 20 bp, Artificial sequence
  Synthetic Oligonucleotide
gtttaaattattgcctttta

SEQ ID NO: 1330 - DNA, 20 bp, Artificial sequence
  Synthetic Oligonucleotide
tgtttaaattattgcctttt

SEQ ID NO: 1331 - DNA, 20 bp, Artificial sequence
  Synthetic Oligonucleotide
atgtttaaattattgccttt

SEQ ID NO: 1332 - DNA, 20 bp, Artificial sequence
  Synthetic Oligonucleotide
tttaataagttcacctattg

SEQ ID NO: 1333 - DNA, 20 bp, Artificial sequence
  Synthetic Oligonucleotide
atttaataagttcacctatt

SEQ ID NO: 1334 - DNA, 20 bp, Artificial sequence
  Synthetic Oligonucleotide
tatttaataagttcacctat

SEQ ID NO: 1335 - DNA, 20 bp, Artificial sequence
  Synthetic Oligonucleotide
ttatttaataagttcaccta

SEQ ID NO: 1336 - DNA, 20 bp, Artificial sequence
  Synthetic Oligonucleotide
gttatttaataagttcacct

SEQ ID NO: 1337 - DNA, 20 bp, Artificial sequence
  Synthetic Oligonucleotide
agttatttaataagttcacc

SEQ ID NO: 1338 - DNA, 20 bp, Artificial sequence
  Synthetic Oligonucleotide
aaaagttatttaataagttc

SEQ ID NO: 1339 - DNA, 20 bp, Artificial sequence
  Synthetic Oligonucleotide
tatttagaaaagttatttaa

SEQ ID NO: 1340 - DNA, 20 bp, Artificial sequence
  Synthetic Oligonucleotide
taaaagtctctaaatttttt

SEQ ID NO: 1341 - DNA, 20 bp, Artificial sequence
  Synthetic Oligonucleotide
ataaaagtctctaaattttt

SEQ ID NO: 1342 - DNA, 20 bp, Artificial sequence
  Synthetic Oligonucleotide
aataaaagtctctaaatttt

SEQ ID NO: 1343 - DNA, 20 bp, Artificial sequence
  Synthetic Oligonucleotide
ttagctcatatgatgccttt

SEQ ID NO: 1344 - DNA, 20 bp, Artificial sequence
  Synthetic Oligonucleotide
attagctcatatgatgcctt

SEQ ID NO: 1345 - DNA, 20 bp, Artificial sequence
  Synthetic Oligonucleotide
atattagctcatatgatgcc

SEQ ID NO: 1346 - DNA, 20 bp, Artificial sequence
  Synthetic Oligonucleotide
gatattagctcatatgatgc

SEQ ID NO: 1347 - DNA, 20 bp, Artificial sequence
  Synthetic Oligonucleotide
tgatattagctcatatgatg

SEQ ID NO: 1348 - DNA, 20 bp, Artificial sequence
  Synthetic Oligonucleotide
gtgatattagctcatatgat

SEQ ID NO: 1349 - DNA, 20 bp, Artificial sequence
  Synthetic Oligonucleotide
gaaagttgtgatattagctc

SEQ ID NO: 1350 - DNA, 20 bp, Artificial sequence
  Synthetic Oligonucleotide
ggaaagttgtgatattagct

SEQ ID NO: 1351 - DNA, 20 bp, Artificial sequence
  Synthetic Oligonucleotide
gggaaagttgtgatattagc

SEQ ID NO: 1352 - DNA, 20 bp, Artificial sequence
  Synthetic Oligonucleotide
tgggaaagttgtgatattag

SEQ ID NO: 1353 - DNA, 20 bp, Artificial sequence
  Synthetic Oligonucleotide
ctgggaaagttgtgatatta

SEQ ID NO: 1354 - DNA, 20 bp, Artificial sequence
  Synthetic Oligonucleotide
actgggaaagttgtgatatt

SEQ ID NO: 1355 - DNA, 20 bp, Artificial sequence
  Synthetic Oligonucleotide
aactgggaaagttgtgatat

SEQ ID NO: 1356 - DNA, 20 bp, Artificial sequence
  Synthetic Oligonucleotide
aaactgggaaagttgtgata

SEQ ID NO: 1357 - DNA, 20 bp, Artificial sequence
  Synthetic Oligonucleotide
taaactgggaaagttgtgat

SEQ ID NO: 1358 - DNA, 20 bp, Artificial sequence
  Synthetic Oligonucleotide
ttaaactgggaaagttgtga

SEQ ID NO: 1359 - DNA, 20 bp, Artificial sequence
  Synthetic Oligonucleotide
tttaaactgggaaagttgtg

SEQ ID NO: 1360 - DNA, 20 bp, Artificial sequence
  Synthetic Oligonucleotide
ttttaaactgggaaagttgt

SEQ ID NO: 1361 - DNA, 20 bp, Artificial sequence
  Synthetic Oligonucleotide
gttttttaaactgggaaagt

SEQ ID NO: 1362 - DNA, 20 bp, Artificial sequence
  Synthetic Oligonucleotide
agttttttaaactgggaaag

SEQ ID NO: 1363 - DNA, 20 bp, Artificial sequence
  Synthetic Oligonucleotide
tagttttttaaactgggaaa

SEQ ID NO: 1364 - DNA, 20 bp, Artificial sequence
  Synthetic Oligonucleotide
gtactagttttttaaactgg

SEQ ID NO: 1365 - DNA, 20 bp, Artificial sequence
  Synthetic Oligonucleotide
agagtactagttttttaaac

SEQ ID NO: 1366 - DNA, 20 bp, Artificial sequence
  Synthetic Oligonucleotide
caagagtactagttttttaa

SEQ ID NO: 1367 - DNA, 20 bp, Artificial sequence
  Synthetic Oligonucleotide
tttaacaagagtactagttt

SEQ ID NO: 1368 - DNA, 20 bp, Artificial sequence
  Synthetic Oligonucleotide
ttttaacaagagtactagtt

SEQ ID NO: 1369 - DNA, 20 bp, Artificial sequence
  Synthetic Oligonucleotide
gttttaacaagagtactagt

SEQ ID NO: 1370 - DNA, 20 bp, Artificial sequence
  Synthetic Oligonucleotide
agttttaacaagagtactag

SEQ ID NO: 1371 - DNA, 20 bp, Artificial sequence
  Synthetic Oligonucleotide
gagttttaacaagagtacta

SEQ ID NO: 1372 - DNA, 20 bp, Artificial sequence
  Synthetic Oligonucleotide
agagttttaacaagagtact

SEQ ID NO: 1373 - DNA, 20 bp, Artificial sequence
  Synthetic Oligonucleotide
tttagagttttaacaagagt

SEQ ID NO: 1374 - DNA, 20 bp, Artificial sequence
  Synthetic Oligonucleotide
gtttagagttttaacaagag

SEQ ID NO: 1375 - DNA, 20 bp, Artificial sequence
  Synthetic Oligonucleotide
aagtttagagttttaacaag

SEQ ID NO: 1376 - DNA, 20 bp, Artificial sequence
  Synthetic Oligonucleotide
caagtttagagttttaacaa

SEQ ID NO: 1377 - DNA, 20 bp, Artificial sequence
  Synthetic Oligonucleotide
tagtcaagtttagagtttta

SEQ ID NO: 1378 - DNA, 20 bp, Artificial sequence
  Synthetic Oligonucleotide
ttagtcaagtttagagtttt

SEQ ID NO: 1379 - DNA, 20 bp, Artificial sequence
  Synthetic Oligonucleotide
tttagtcaagtttagagttt

SEQ ID NO: 1380 - DNA, 20 bp, Artificial sequence
  Synthetic Oligonucleotide
tgtatttagtcaagtttaga

SEQ ID NO: 1381 - DNA, 20 bp, Artificial sequence
  Synthetic Oligonucleotide
ctgtatttagtcaagtttag

SEQ ID NO: 1382 - DNA, 20 bp, Artificial sequence
  Synthetic Oligonucleotide
tctgtatttagtcaagttta

SEQ ID NO: 1383 - DNA, 20 bp, Artificial sequence
  Synthetic Oligonucleotide
gtcctctgtatttagtcaag

SEQ ID NO: 1384 - DNA, 20 bp, Artificial sequence
  Synthetic Oligonucleotide
agtcctctgtatttagtcaa

SEQ ID NO: 1385 - DNA, 20 bp, Artificial sequence
  Synthetic Oligonucleotide
cagtcctctgtatttagtca

SEQ ID NO: 1386 - DNA, 20 bp, Artificial sequence
  Synthetic Oligonucleotide
ccagtcctctgtatttagtc

SEQ ID NO: 1387 - DNA, 20 bp, Artificial sequence
  Synthetic Oligonucleotide
accagtcctctgtatttagt

SEQ ID NO: 1388 - DNA, 20 bp, Artificial sequence
  Synthetic Oligonucleotide
taccagtcctctgtatttag

SEQ ID NO: 1389 - DNA, 20 bp, Artificial sequence
  Synthetic Oligonucleotide
ttaccagtcctctgtattta

SEQ ID NO: 1390 - DNA, 20 bp, Artificial sequence
  Synthetic Oligonucleotide
attaccagtcctctgtattt

SEQ ID NO: 1391 - DNA, 20 bp, Artificial sequence
  Synthetic Oligonucleotide
aattaccagtcctctgtatt

SEQ ID NO: 1392 - DNA, 20 bp, Artificial sequence
  Synthetic Oligonucleotide
caattaccagtcctctgtat

SEQ ID NO: 1393 - DNA, 20 bp, Artificial sequence
  Synthetic Oligonucleotide
acaattaccagtcctctgta

SEQ ID NO: 1394 - DNA, 20 bp, Artificial sequence
  Synthetic Oligonucleotide
tacaattaccagtcctctgt

SEQ ID NO: 1395 - DNA, 20 bp, Artificial sequence
  Synthetic Oligonucleotide
gtacaattaccagtcctctg

SEQ ID NO: 1396 - DNA, 20 bp, Artificial sequence
  Synthetic Oligonucleotide
tgtacaattaccagtcctct

SEQ ID NO: 1397 - DNA, 20 bp, Artificial sequence
  Synthetic Oligonucleotide
ctgtacaattaccagtcctc

SEQ ID NO: 1398 - DNA, 20 bp, Artificial sequence
  Synthetic Oligonucleotide
actgtacaattaccagtcct

SEQ ID NO: 1399 - DNA, 20 bp, Artificial sequence
  Synthetic Oligonucleotide
aactgtacaattaccagtcc

SEQ ID NO: 1400 - DNA, 20 bp, Artificial sequence
  Synthetic Oligonucleotide
gaactgtacaattaccagtc

SEQ ID NO: 1401 - DNA, 20 bp, Artificial sequence
  Synthetic Oligonucleotide
agaactgtacaattaccagt

SEQ ID NO: 1402 - DNA, 20 bp, Artificial sequence
  Synthetic Oligonucleotide
taagaactgtacaattacca

SEQ ID NO: 1403 - DNA, 20 bp, Artificial sequence
  Synthetic Oligonucleotide
ttaagaactgtacaattacc

SEQ ID NO: 1404 - DNA, 20 bp, Artificial sequence
  Synthetic Oligonucleotide
tttaagaactgtacaattac

SEQ ID NO: 1405 - DNA, 20 bp, Artificial sequence
  Synthetic Oligonucleotide
acttgaaattataataggaa

SEQ ID NO: 1406 - DNA, 20 bp, Artificial sequence
  Synthetic Oligonucleotide
aaaaaactaacttgaaatta

SEQ ID NO: 1407 - DNA, 20 bp, Artificial sequence
  Synthetic Oligonucleotide
gaaacaaaaaactaacttga

SEQ ID NO: 1408 - DNA, 20 bp, Artificial sequence
  Synthetic Oligonucleotide
gtgttttcatatataacatt

SEQ ID NO: 1409 - DNA, 20 bp, Artificial sequence
  Synthetic Oligonucleotide
aattttcagtgttttcatat

SEQ ID NO: 1410 - DNA, 20 bp, Artificial sequence
  Synthetic Oligonucleotide
aaaatgcaaattttcagtgt

SEQ ID NO: 1411 - DNA, 20 bp, Artificial sequence
  Synthetic Oligonucleotide
gtaattttcatataaaatgc

SEQ ID NO: 1412 - DNA, 20 bp, Artificial sequence
  Synthetic Oligonucleotide
gatttgtaattttcatataa

SEQ ID NO: 1413 - DNA, 20 bp, Artificial sequence
  Synthetic Oligonucleotide
taaccgatttgtaattttca

SEQ ID NO: 1414 - DNA, 20 bp, Artificial sequence
  Synthetic Oligonucleotide
taatttaaccgatttgtaat

SEQ ID NO: 1415 - DNA, 20 bp, Artificial sequence
  Synthetic Oligonucleotide
ttgtataatttaaccgattt

SEQ ID NO: 1416 - DNA, 20 bp, Artificial sequence
  Synthetic Oligonucleotide
ctagattgtataatttaacc

SEQ ID NO: 1417 - DNA, 20 bp, Artificial sequence
  Synthetic Oligonucleotide
gtgttctagattgtataatt

SEQ ID NO: 1418 - DNA, 20 bp, Artificial sequence
  Synthetic Oligonucleotide
aatgacatagtgttctagat

SEQ ID NO: 1419 - DNA, 20 bp, Artificial sequence
  Synthetic Oligonucleotide
agtgtaatgacatagtgttc

SEQ ID NO: 1420 - DNA, 20 bp, Artificial sequence
  Synthetic Oligonucleotide
ttacaatagtgtaatgacat

SEQ ID NO: 1421 - DNA, 20 bp, Artificial sequence
  Synthetic Oligonucleotide
ttcagtaatttacaatagtg

SEQ ID NO: 1422 - DNA, 20 bp, Artificial sequence
  Synthetic Oligonucleotide
ttaccttcagtaatttacaa

SEQ ID NO: 1423 - DNA, 20 bp, Artificial sequence
  Synthetic Oligonucleotide
ttaactttttacttaccttc

SEQ ID NO: 1424 - DNA, 20 bp, Artificial sequence
  Synthetic Oligonucleotide
gaatagttttaaattttttt

SEQ ID NO: 1425 - DNA, 20 bp, Artificial sequence
  Synthetic Oligonucleotide
acactggagaatagttttaa

SEQ ID NO: 1426 - DNA, 20 bp, Artificial sequence
  Synthetic Oligonucleotide
tttaaacactggagaatagt

SEQ ID NO: 1427 - DNA, 20 bp, Artificial sequence
  Synthetic Oligonucleotide
tctgttttaaacactggaga

SEQ ID NO: 1428 - DNA, 20 bp, Artificial sequence
  Synthetic Oligonucleotide
gtattatttaatctgtttta

SEQ ID NO: 1429 - DNA, 20 bp, Artificial sequence
  Synthetic Oligonucleotide
ttactgtattatttaatctg

SEQ ID NO: 1430 - DNA, 20 bp, Artificial sequence
  Synthetic Oligonucleotide
taaatcttttccatttactg

SEQ ID NO: 1431 - DNA, 20 bp, Artificial sequence
  Synthetic Oligonucleotide
atgaataaatcttttccatt

SEQ ID NO: 1432 - DNA, 20 bp, Artificial sequence
  Synthetic Oligonucleotide
gcatattttcatatgaataa

SEQ ID NO: 1433 - DNA, 20 bp, Artificial sequence
  Synthetic Oligonucleotide
gcccagcatattttcatatg

SEQ ID NO: 1434 - DNA, 20 bp, Artificial sequence
  Synthetic Oligonucleotide
aaaagaaaaagcccagcata

SEQ ID NO: 1435 - DNA, 20 bp, Artificial sequence
  Synthetic Oligonucleotide
ctgaacttcaattaaaagaa

SEQ ID NO: 1436 - DNA, 20 bp, Artificial sequence
  Synthetic Oligonucleotide
gattttctgaacttcaatta

SEQ ID NO: 1437 - DNA, 20 bp, Artificial sequence
  Synthetic Oligonucleotide
tctaaaatttgattttctga

SEQ ID NO: 1438 - DNA, 20 bp, Artificial sequence
  Synthetic Oligonucleotide
actatctctaaaatttgatt

SEQ ID NO: 1439 - DNA, 20 bp, Artificial sequence
  Synthetic Oligonucleotide
ttaaattgtactatctctaa

SEQ ID NO: 1440 - DNA, 20 bp, Artificial sequence
  Synthetic Oligonucleotide
acattttatttaaattgtac

SEQ ID NO: 1441 - DNA, 20 bp, Artificial sequence
  Synthetic Oligonucleotide
gtccttaacattttatttaa

SEQ ID NO: 1442 - DNA, 20 bp, Artificial sequence
  Synthetic Oligonucleotide
catatttttgtccttaacat

SEQ ID NO: 1443 - DNA, 20 bp, Artificial sequence
  Synthetic Oligonucleotide
tagcacatatttttgtcctt

SEQ ID NO: 1444 - DNA, 20 bp, Artificial sequence
  Synthetic Oligonucleotide
tcaaatagcacatatttttg

SEQ ID NO: 1445 - DNA, 20 bp, Artificial sequence
  Synthetic Oligonucleotide
cttctttcaaatagcacata

SEQ ID NO: 1446 - DNA, 20 bp, Artificial sequence
  Synthetic Oligonucleotide
cttgtatgcttctttcaaat

SEQ ID NO: 1447 - DNA, 20 bp, Artificial sequence
  Synthetic Oligonucleotide
attccttccccttgtatgct

SEQ ID NO: 1448 - DNA, 20 bp, Artificial sequence
  Synthetic Oligonucleotide
ttggcaattccttccccttg

SEQ ID NO: 1449 - DNA, 20 bp, Artificial sequence
  Synthetic Oligonucleotide
gaatattggcaattccttcc

SEQ ID NO: 1450 - DNA, 20 bp, Artificial sequence
  Synthetic Oligonucleotide
tgaaaaatgaatattggcaa

SEQ ID NO: 1451 - DNA, 20 bp, Artificial sequence
  Synthetic Oligonucleotide
taatggatttgaaaaatgaa

SEQ ID NO: 1452 - DNA, 20 bp, Artificial sequence
  Synthetic Oligonucleotide
actaataatggatttgaaaa

SEQ ID NO: 1453 - DNA, 20 bp, Artificial sequence
  Synthetic Oligonucleotide
cataatctaaatttttaaac

SEQ ID NO: 1454 - DNA, 20 bp, Artificial sequence
  Synthetic Oligonucleotide
cactatcataatctaaattt

SEQ ID NO: 1455 - DNA, 20 bp, Artificial sequence
  Synthetic Oligonucleotide
aatttcctgtaacactatca

SEQ ID NO: 1456 - DNA, 20 bp, Artificial sequence
  Synthetic Oligonucleotide
ctattaatttcctgtaacac

SEQ ID NO: 1457 - DNA, 20 bp, Artificial sequence
  Synthetic Oligonucleotide
cttttctattaatttcctgt

SEQ ID NO: 1458 - DNA, 20 bp, Artificial sequence
  Synthetic Oligonucleotide
ctctttcttttctattaatt

SEQ ID NO: 1459 - DNA, 20 bp, Artificial sequence
  Synthetic Oligonucleotide
agttgctttcctctttcttt

SEQ ID NO: 1460 - DNA, 20 bp, Artificial sequence
  Synthetic Oligonucleotide
ttataagttgctttcctctt

SEQ ID NO: 1461 - DNA, 20 bp, Artificial sequence
  Synthetic Oligonucleotide
gttggttataagttgctttc

SEQ ID NO: 1462 - DNA, 20 bp, Artificial sequence
  Synthetic Oligonucleotide
agtaggttggttataagttg

SEQ ID NO: 1463 - DNA, 20 bp, Artificial sequence
  Synthetic Oligonucleotide
tagagagtaggttggttata

SEQ ID NO: 1464 - DNA, 20 bp, Artificial sequence
  Synthetic Oligonucleotide
ggatatagagagtaggttgg

SEQ ID NO: 1465 - DNA, 20 bp, Artificial sequence
  Synthetic Oligonucleotide
agtctggatatagagagtag

SEQ ID NO: 1466 - DNA, 20 bp, Artificial sequence
  Synthetic Oligonucleotide
tacaaaagtctggatataga

SEQ ID NO: 1467 - DNA, 20 bp, Artificial sequence
  Synthetic Oligonucleotide
gtttttctacaaaagtctgg

SEQ ID NO: 1468 - DNA, 20 bp, Artificial sequence
  Synthetic Oligonucleotide
ttacctgattttctatttct

SEQ ID NO: 1469 - DNA, 20 bp, Artificial sequence
  Synthetic Oligonucleotide
atactgacttacctgatttt

SEQ ID NO: 1470 - DNA, 20 bp, Artificial sequence
  Synthetic Oligonucleotide
ttaaaatactgacttacctg

SEQ ID NO: 1471 - DNA, 20 bp, Artificial sequence
  Synthetic Oligonucleotide
taccattaaaatactgactt

SEQ ID NO: 1472 - DNA, 20 bp, Artificial sequence
  Synthetic Oligonucleotide
ggacataccattaaaatact

SEQ ID NO: 1473 - DNA, 20 bp, Artificial sequence
  Synthetic Oligonucleotide
aaagatgggacataccatta

SEQ ID NO: 1474 - DNA, 20 bp, Artificial sequence
  Synthetic Oligonucleotide
agacctgtgtgaaagatggg

SEQ ID NO: 1475 - DNA, 20 bp, Artificial sequence
  Synthetic Oligonucleotide
tttacagacctgtgtgaaag

SEQ ID NO: 1476 - DNA, 20 bp, Artificial sequence
  Synthetic Oligonucleotide
gtgtttttacagacctgtgt

SEQ ID NO: 1477 - DNA, 20 bp, Artificial sequence
  Synthetic Oligonucleotide
attcagtgtttttacagacc

SEQ ID NO: 1478 - DNA, 20 bp, Artificial sequence
  Synthetic Oligonucleotide
ttaggattcagtgtttttac

SEQ ID NO: 1479 - DNA, 20 bp, Artificial sequence
  Synthetic Oligonucleotide
ataattttaggattcagtgt

SEQ ID NO: 1480 - DNA, 20 bp, Artificial sequence
  Synthetic Oligonucleotide
gcttgtaaataattttagga

SEQ ID NO: 1481 - DNA, 20 bp, Artificial sequence
  Synthetic Oligonucleotide
gttaaagcttgtaaataatt

SEQ ID NO: 1482 - DNA, 20 bp, Artificial sequence
  Synthetic Oligonucleotide
tgttttatatctcttgaaaa

SEQ ID NO: 1483 - DNA, 20 bp, Artificial sequence
  Synthetic Oligonucleotide
ttggtaataatatttgtttt

SEQ ID NO: 1484 - DNA, 20 bp, Artificial sequence
  Synthetic Oligonucleotide
ggaaattggtaataatattt

SEQ ID NO: 1485 - DNA, 20 bp, Artificial sequence
  Synthetic Oligonucleotide
ttagtggaaattggtaataa

SEQ ID NO: 1486 - DNA, 20 bp, Artificial sequence
  Synthetic Oligonucleotide
tttgtttagtggaaattggt

SEQ ID NO: 1487 - DNA, 20 bp, Artificial sequence
  Synthetic Oligonucleotide
ttatgtttgtttagtggaaa

SEQ ID NO: 1488 - DNA, 20 bp, Artificial sequence
  Synthetic Oligonucleotide
taacattatgtttgtttagt

SEQ ID NO: 1489 - DNA, 20 bp, Artificial sequence
  Synthetic Oligonucleotide
actactaacattatgtttgt

SEQ ID NO: 1490 - DNA, 20 bp, Artificial sequence
  Synthetic Oligonucleotide
gcagcactactaacattatg

SEQ ID NO: 1491 - DNA, 20 bp, Artificial sequence
  Synthetic Oligonucleotide
ttttagcagcactactaaca

SEQ ID NO: 1492 - DNA, 20 bp, Artificial sequence
  Synthetic Oligonucleotide
aaaccttttagcagcactac

SEQ ID NO: 1493 - DNA, 20 bp, Artificial sequence
  Synthetic Oligonucleotide
gataaaaaaccttttagcag

SEQ ID NO: 1494 - DNA, 20 bp, Artificial sequence
  Synthetic Oligonucleotide
tagttgataaaaaacctttt

SEQ ID NO: 1495 - DNA, 20 bp, Artificial sequence
  Synthetic Oligonucleotide
caaaagtagttgataaaaaa

SEQ ID NO: 1496 - DNA, 20 bp, Artificial sequence
  Synthetic Oligonucleotide
atggaaaccaaaagtagttg

SEQ ID NO: 1497 - DNA, 20 bp, Artificial sequence
  Synthetic Oligonucleotide
aaagtatggaaaccaaaagt

SEQ ID NO: 1498 - DNA, 20 bp, Artificial sequence
  Synthetic Oligonucleotide
gaaggaaagtatggaaacca

SEQ ID NO: 1499 - DNA, 20 bp, Artificial sequence
  Synthetic Oligonucleotide
cataagaaggaaagtatgga

SEQ ID NO: 1500 - DNA, 20 bp, Artificial sequence
  Synthetic Oligonucleotide
taacatcataagaaggaaag

SEQ ID NO: 1501 - DNA, 20 bp, Artificial sequence
  Synthetic Oligonucleotide
gaataataacatcataagaa

SEQ ID NO: 1502 - DNA, 20 bp, Artificial sequence
  Synthetic Oligonucleotide
gaatttagaataataacatc

SEQ ID NO: 1503 - DNA, 20 bp, Artificial sequence
  Synthetic Oligonucleotide
tataattgaaaagaatttag

SEQ ID NO: 1504 - DNA, 20 bp, Artificial sequence
  Synthetic Oligonucleotide
tagtaaaagatataattgaa

SEQ ID NO: 1505 - DNA, 20 bp, Artificial sequence
  Synthetic Oligonucleotide
aatcatagtaaaagatataa

SEQ ID NO: 1506 - DNA, 20 bp, Artificial sequence
  Synthetic Oligonucleotide
caggttcatttaatcatagt

SEQ ID NO: 1507 - DNA, 20 bp, Artificial sequence
  Synthetic Oligonucleotide
ctatagtaacattttgcttt

SEQ ID NO: 1508 - DNA, 20 bp, Artificial sequence
  Synthetic Oligonucleotide
gtatattactatagtaacat

SEQ ID NO: 1509 - DNA, 20 bp, Artificial sequence
  Synthetic Oligonucleotide
acaatgtatattactatagt

SEQ ID NO: 1510 - DNA, 20 bp, Artificial sequence
  Synthetic Oligonucleotide
tagacacaatgtatattact

SEQ ID NO: 1511 - DNA, 20 bp, Artificial sequence
  Synthetic Oligonucleotide
tatttttagacacaatgtat

SEQ ID NO: 1512 - DNA, 20 bp, Artificial sequence
  Synthetic Oligonucleotide
acacatttttatttttagac

SEQ ID NO: 1513 - DNA, 20 bp, Artificial sequence
  Synthetic Oligonucleotide
ttggtttcttcacacatttt

SEQ ID NO: 1514 - DNA, 20 bp, Artificial sequence
  Synthetic Oligonucleotide
ttcattgttttggtttcttc

SEQ ID NO: 1515 - DNA, 20 bp, Artificial sequence
  Synthetic Oligonucleotide
cagaaattcattgttttggt

SEQ ID NO: 1516 - DNA, 20 bp, Artificial sequence
  Synthetic Oligonucleotide
cttcttccaactcagaaatt

SEQ ID NO: 1517 - DNA, 20 bp, Artificial sequence
  Synthetic Oligonucleotide
tgatctaactcttcttccaa

SEQ ID NO: 1518 - DNA, 20 bp, Artificial sequence
  Synthetic Oligonucleotide
ttaaatgatctaactcttct

SEQ ID NO: 1519 - DNA, 20 bp, Artificial sequence
  Synthetic Oligonucleotide
tgagaaagttaaatgatcta

SEQ ID NO: 1520 - DNA, 20 bp, Artificial sequence
  Synthetic Oligonucleotide
tacttaaatttttagagttt

SEQ ID NO: 1521 - DNA, 20 bp, Artificial sequence
  Synthetic Oligonucleotide
aaagttacttaaatttttag

SEQ ID NO: 1522 - DNA, 20 bp, Artificial sequence
  Synthetic Oligonucleotide
atcttaaagttacttaaatt

SEQ ID NO: 1523 - DNA, 20 bp, Artificial sequence
  Synthetic Oligonucleotide
atgtgatcttaaagttactt

SEQ ID NO: 1524 - DNA, 20 bp, Artificial sequence
  Synthetic Oligonucleotide
taactatgtgatcttaaagt

SEQ ID NO: 1525 - DNA, 20 bp, Artificial sequence
  Synthetic Oligonucleotide
ttactcttttctactaagta

SEQ ID NO: 1526 - DNA, 20 bp, Artificial sequence
  Synthetic Oligonucleotide
gggtattactcttttctact

SEQ ID NO: 1527 - DNA, 20 bp, Artificial sequence
  Synthetic Oligonucleotide
taaagtttgcttgctgggta

SEQ ID NO: 1528 - DNA, 20 bp, Artificial sequence
  Synthetic Oligonucleotide
tattgtaaagtttgcttgct

SEQ ID NO: 1529 - DNA, 20 bp, Artificial sequence
  Synthetic Oligonucleotide
taaaaggatctattgtaaag

SEQ ID NO: 1530 - DNA, 20 bp, Artificial sequence
  Synthetic Oligonucleotide
ttatttaaaaggatctattg

SEQ ID NO: 1531 - DNA, 20 bp, Artificial sequence
  Synthetic Oligonucleotide
ggaccttatttaaaaggatc

SEQ ID NO: 1532 - DNA, 20 bp, Artificial sequence
  Synthetic Oligonucleotide
gatatttcctaggaccttat

SEQ ID NO: 1533 - DNA, 20 bp, Artificial sequence
  Synthetic Oligonucleotide
tgaatgatatttcctaggac

SEQ ID NO: 1534 - DNA, 20 bp, Artificial sequence
  Synthetic Oligonucleotide
gatgctggcatgaatgatat

SEQ ID NO: 1535 - DNA, 20 bp, Artificial sequence
  Synthetic Oligonucleotide
ttttttgatgctggcatgaa

SEQ ID NO: 1536 - DNA, 20 bp, Artificial sequence
  Synthetic Oligonucleotide
gttagttttttgatgctggc

SEQ ID NO: 1537 - DNA, 20 bp, Artificial sequence
  Synthetic Oligonucleotide
ttagtgttagttttttgatg

SEQ ID NO: 1538 - DNA, 20 bp, Artificial sequence
  Synthetic Oligonucleotide
gcattattagtgttagtttt

SEQ ID NO: 1539 - DNA, 20 bp, Artificial sequence
  Synthetic Oligonucleotide
atcttgcattattagtgtta

SEQ ID NO: 1540 - DNA, 20 bp, Artificial sequence
  Synthetic Oligonucleotide
ataatatcttgcattattag

SEQ ID NO: 1541 - DNA, 20 bp, Artificial sequence
  Synthetic Oligonucleotide
cagtaagaaaagcagaatat

SEQ ID NO: 1542 - DNA, 20 bp, Artificial sequence
  Synthetic Oligonucleotide
tcattgacagtaagaaaagc

SEQ ID NO: 1543 - DNA, 20 bp, Artificial sequence
  Synthetic Oligonucleotide
gatagtttttctcattgaca

SEQ ID NO: 1544 - DNA, 20 bp, Artificial sequence
  Synthetic Oligonucleotide
gtttgcaatttattgaatga

SEQ ID NO: 1545 - DNA, 20 bp, Artificial sequence
  Synthetic Oligonucleotide
gtgttgggtttgcaatttat

SEQ ID NO: 1546 - DNA, 20 bp, Artificial sequence
  Synthetic Oligonucleotide
ttaagtgtgttgggtttgca

SEQ ID NO: 1547 - DNA, 20 bp, Artificial sequence
  Synthetic Oligonucleotide
ttttatttaagtgtgttggg

SEQ ID NO: 1548 - DNA, 20 bp, Artificial sequence
  Synthetic Oligonucleotide
tttagcagtaacattttatt

SEQ ID NO: 1549 - DNA, 20 bp, Artificial sequence
  Synthetic Oligonucleotide
gttagtttagcagtaacatt

SEQ ID NO: 1550 - DNA, 20 bp, Artificial sequence
  Synthetic Oligonucleotide
tctatatattcagtagttta

SEQ ID NO: 1551 - DNA, 20 bp, Artificial sequence
  Synthetic Oligonucleotide
ttactttctatatattcagt

SEQ ID NO: 1552 - DNA, 20 bp, Artificial sequence
  Synthetic Oligonucleotide
gtttgcttactttctatata

SEQ ID NO: 1553 - DNA, 20 bp, Artificial sequence
  Synthetic Oligonucleotide
agtttgtttgcttactttct

SEQ ID NO: 1554 - DNA, 20 bp, Artificial sequence
  Synthetic Oligonucleotide
tggcaagtttgtttgcttac

SEQ ID NO: 1555 - DNA, 20 bp, Artificial sequence
  Synthetic Oligonucleotide
ttactgttactgtatttccc

SEQ ID NO: 1556 - DNA, 20 bp, Artificial sequence
  Synthetic Oligonucleotide
atgtagttactgttactgta

SEQ ID NO: 1557 - DNA, 20 bp, Artificial sequence
  Synthetic Oligonucleotide
atgcaatttaatgggtacag

SEQ ID NO: 1558 - DNA, 20 bp, Artificial sequence
  Synthetic Oligonucleotide
tagatatgcaatttaatggg

SEQ ID NO: 1559 - DNA, 20 bp, Artificial sequence
  Synthetic Oligonucleotide
aggagatagatatgcaattt

SEQ ID NO: 1560 - DNA, 20 bp, Artificial sequence
  Synthetic Oligonucleotide
cctaaaggagatagatatgc

SEQ ID NO: 1561 - DNA, 20 bp, Artificial sequence
  Synthetic Oligonucleotide
agcctcctaaaggagataga

SEQ ID NO: 1562 - DNA, 20 bp, Artificial sequence
  Synthetic Oligonucleotide
caccaccagcctcctaaagg

SEQ ID NO: 1563 - DNA, 20 bp, Artificial sequence
  Synthetic Oligonucleotide
atctaagaaaattaataaac

SEQ ID NO: 1564 - DNA, 20 bp, Artificial sequence
  Synthetic Oligonucleotide
atgatcacatctaagaaaat

SEQ ID NO: 1565 - DNA, 20 bp, Artificial sequence
  Synthetic Oligonucleotide
aactgcaataccatgatcac

SEQ ID NO: 1566 - DNA, 20 bp, Artificial sequence
  Synthetic Oligonucleotide
taaaactgcaataccatgat

SEQ ID NO: 1567 - DNA, 20 bp, Artificial sequence
  Synthetic Oligonucleotide
ctttaaaactgcaataccat

SEQ ID NO: 1568 - DNA, 20 bp, Artificial sequence
  Synthetic Oligonucleotide
tctcctttaaaactgcaata

SEQ ID NO: 1569 - DNA, 20 bp, Artificial sequence
  Synthetic Oligonucleotide
tgttctcctttaaaactgca

SEQ ID NO: 1570 - DNA, 20 bp, Artificial sequence
  Synthetic Oligonucleotide
gattgttctcctttaaaact

SEQ ID NO: 1571 - DNA, 20 bp, Artificial sequence
  Synthetic Oligonucleotide
aggagattgttctcctttaa

SEQ ID NO: 1572 - DNA, 20 bp, Artificial sequence
  Synthetic Oligonucleotide
aacaggagattgttctcctt

SEQ ID NO: 1573 - DNA, 20 bp, Artificial sequence
  Synthetic Oligonucleotide
ttaaacaggagattgttctc

SEQ ID NO: 1574 - DNA, 20 bp, Artificial sequence
  Synthetic Oligonucleotide
ctcttaaacaggagattgtt

SEQ ID NO: 1575 - DNA, 20 bp, Artificial sequence
  Synthetic Oligonucleotide
ctttaactccgtaaatattt

SEQ ID NO: 1576 - DNA, 20 bp, Artificial sequence
  Synthetic Oligonucleotide
agtgacctttaactccgtaa

SEQ ID NO: 1577 - DNA, 20 bp, Artificial sequence
  Synthetic Oligonucleotide
ggagtccagtgacctttaac

SEQ ID NO: 1578 - DNA, 20 bp, Artificial sequence
  Synthetic Oligonucleotide
accagtctggagtccagtga

SEQ ID NO: 1579 - DNA, 20 bp, Artificial sequence
  Synthetic Oligonucleotide
tcatcttaccaaactatttt

SEQ ID NO: 1580 - DNA, 20 bp, Artificial sequence
  Synthetic Oligonucleotide
gaatcatcttaccaaactat

SEQ ID NO: 1581 - DNA, 20 bp, Artificial sequence
  Synthetic Oligonucleotide
taagaatcatcttaccaaac

SEQ ID NO: 1582 - DNA, 20 bp, Artificial sequence
  Synthetic Oligonucleotide
aagaatgtaagaatcatctt

SEQ ID NO: 1583 - DNA, 20 bp, Artificial sequence
  Synthetic Oligonucleotide
gttatttaagaatgtaagaa

SEQ ID NO: 1584 - DNA, 20 bp, Artificial sequence
  Synthetic Oligonucleotide
cgtgttatttaagaatgtaa

SEQ ID NO: 1585 - DNA, 20 bp, Artificial sequence
  Synthetic Oligonucleotide
taaagcatttttcttagatg

SEQ ID NO: 1586 - DNA, 20 bp, Artificial sequence
  Synthetic Oligonucleotide
tgttaaagcatttttcttag

SEQ ID NO: 1587 - DNA, 20 bp, Artificial sequence
  Synthetic Oligonucleotide
tttatgttaaagcatttttc

SEQ ID NO: 1588 - DNA, 20 bp, Artificial sequence
  Synthetic Oligonucleotide
atgtttatgttaaagcattt

SEQ ID NO: 1589 - DNA, 20 bp, Artificial sequence
  Synthetic Oligonucleotide
gcattttttcagtaatgttt

SEQ ID NO: 1590 - DNA, 20 bp, Artificial sequence
  Synthetic Oligonucleotide
tgtagcattttttcagtaat

SEQ ID NO: 1591 - DNA, 20 bp, Artificial sequence
  Synthetic Oligonucleotide
caaatgtagcattttttcag

SEQ ID NO: 1592 - DNA, 20 bp, Artificial sequence
  Synthetic Oligonucleotide
aagttgtggcaaatgtagca

SEQ ID NO: 1593 - DNA, 20 bp, Artificial sequence
  Synthetic Oligonucleotide
atgaagttgtggcaaatgta

SEQ ID NO: 1594 - DNA, 20 bp, Artificial sequence
  Synthetic Oligonucleotide
tttatgaagttgtggcaaat

SEQ ID NO: 1595 - DNA, 20 bp, Artificial sequence
  Synthetic Oligonucleotide
tgacattttatgaagttgtg

SEQ ID NO: 1596 - DNA, 20 bp, Artificial sequence
  Synthetic Oligonucleotide
cttgagatttcacttgacat

SEQ ID NO: 1597 - DNA, 20 bp, Artificial sequence
  Synthetic Oligonucleotide
tttggagcttgagatttcac

SEQ ID NO: 1598 - DNA, 20 bp, Artificial sequence
  Synthetic Oligonucleotide
atctttggagcttgagattt

SEQ ID NO: 1599 - DNA, 20 bp, Artificial sequence
  Synthetic Oligonucleotide
aatatctttggagcttgaga

SEQ ID NO: 1600 - DNA, 20 bp, Artificial sequence
  Synthetic Oligonucleotide
aataatatctttggagcttg

SEQ ID NO: 1601 - DNA, 20 bp, Artificial sequence
  Synthetic Oligonucleotide
aggaataatatctttggagc

SEQ ID NO: 1602 - DNA, 20 bp, Artificial sequence
  Synthetic Oligonucleotide
aataggaataatatctttgg

SEQ ID NO: 1603 - DNA, 20 bp, Artificial sequence
  Synthetic Oligonucleotide
agtaataggaataatatctt

SEQ ID NO: 1604 - DNA, 20 bp, Artificial sequence
  Synthetic Oligonucleotide
ttacatcagatttagtaata

SEQ ID NO: 1605 - DNA, 20 bp, Artificial sequence
  Synthetic Oligonucleotide
aaatgttattacatcagatt

SEQ ID NO: 1606 - DNA, 20 bp, Artificial sequence
  Synthetic Oligonucleotide
ataaaatgttattacatcag

SEQ ID NO: 1607 - DNA, 20 bp, Artificial sequence
  Synthetic Oligonucleotide
cctagaatcaataaaatgtt

SEQ ID NO: 1608 - DNA, 20 bp, Artificial sequence
  Synthetic Oligonucleotide
aggaatgcctagaatcaata

SEQ ID NO: 1609 - DNA, 20 bp, Artificial sequence
  Synthetic Oligonucleotide
attcagcaggaatgcctaga

SEQ ID NO: 1610 - DNA, 20 bp, Artificial sequence
  Synthetic Oligonucleotide
tacattcagcaggaatgcct

SEQ ID NO: 1611 - DNA, 20 bp, Artificial sequence
  Synthetic Oligonucleotide
ttacctgatataacatcaca

SEQ ID NO: 1612 - DNA, 20 bp, Artificial sequence
  Synthetic Oligonucleotide
gttttacctgatataacatc

SEQ ID NO: 1613 - DNA, 20 bp, Artificial sequence
  Synthetic Oligonucleotide
caggttttacctgatataac

SEQ ID NO: 1614 - DNA, 20 bp, Artificial sequence
  Synthetic Oligonucleotide
ttagacaggttttacctgat

SEQ ID NO: 1615 - DNA, 20 bp, Artificial sequence
  Synthetic Oligonucleotide
attctccttagacaggtttt

SEQ ID NO: 1616 - DNA, 20 bp, Artificial sequence
  Synthetic Oligonucleotide
actgtctattctccttagac

SEQ ID NO: 1617 - DNA, 20 bp, Artificial sequence
  Synthetic Oligonucleotide
actactgtctattctcctta

SEQ ID NO: 1618 - DNA, 20 bp, Artificial sequence
  Synthetic Oligonucleotide
actaactactgtctattctc

SEQ ID NO: 1619 - DNA, 20 bp, Artificial sequence
  Synthetic Oligonucleotide
tgaactaactactgtctatt

SEQ ID NO: 1620 - DNA, 20 bp, Artificial sequence
  Synthetic Oligonucleotide
agttgaactaactactgtct

SEQ ID NO: 1621 - DNA, 20 bp, Artificial sequence
  Synthetic Oligonucleotide
attaattgatatgtaaaacg

SEQ ID NO: 1622 - DNA, 20 bp, Artificial sequence
  Synthetic Oligonucleotide
ccaattaattgatatgtaaa

SEQ ID NO: 1623 - DNA, 20 bp, Artificial sequence
  Synthetic Oligonucleotide
tccttttaacttccaattaa

SEQ ID NO: 1624 - DNA, 20 bp, Artificial sequence
  Synthetic Oligonucleotide
gtttcctggtccttttaact

SEQ ID NO: 1625 - DNA, 20 bp, Artificial sequence
  Synthetic Oligonucleotide
tctgagtttcctggtccttt

SEQ ID NO: 1626 - DNA, 20 bp, Artificial sequence
  Synthetic Oligonucleotide
atgtctgagtttcctggtcc

SEQ ID NO: 1627 - DNA, 20 bp, Artificial sequence
  Synthetic Oligonucleotide
tgtatgtctgagtttcctgg

SEQ ID NO: 1628 - DNA, 20 bp, Artificial sequence
  Synthetic Oligonucleotide
atgtatactgtatgtctgag

SEQ ID NO: 1629 - DNA, 20 bp, Artificial sequence
  Synthetic Oligonucleotide
aaaatgtatactgtatgtct

SEQ ID NO: 1630 - DNA, 20 bp, Artificial sequence
  Synthetic Oligonucleotide
ttttaaaatgtatactgtat

SEQ ID NO: 1631 - DNA, 20 bp, Artificial sequence
  Synthetic Oligonucleotide
catacattctatatattata

SEQ ID NO: 1632 - DNA, 20 bp, Artificial sequence
  Synthetic Oligonucleotide
attataagccatacattcta

SEQ ID NO: 1633 - DNA, 20 bp, Artificial sequence
  Synthetic Oligonucleotide
ttcattataagccatacatt

SEQ ID NO: 1634 - DNA, 20 bp, Artificial sequence
  Synthetic Oligonucleotide
taattcattataagccatac

SEQ ID NO: 1635 - DNA, 20 bp, Artificial sequence
  Synthetic Oligonucleotide
tgagttaactaattcattat

SEQ ID NO: 1636 - DNA, 20 bp, Artificial sequence
  Synthetic Oligonucleotide
tttgcattgagttaactaat

SEQ ID NO: 1637 - DNA, 20 bp, Artificial sequence
  Synthetic Oligonucleotide
taatttgcattgagttaact

SEQ ID NO: 1638 - DNA, 20 bp, Artificial sequence
  Synthetic Oligonucleotide
gaataatttgcattgagtta

SEQ ID NO: 1639 - DNA, 20 bp, Artificial sequence
  Synthetic Oligonucleotide
atagaataatttgcattgag

SEQ ID NO: 1640 - DNA, 20 bp, Artificial sequence
  Synthetic Oligonucleotide
aaaatagaataatttgcatt

SEQ ID NO: 1641 - DNA, 20 bp, Artificial sequence
  Synthetic Oligonucleotide
ttgtaatcaaaatagaataa

SEQ ID NO: 1642 - DNA, 20 bp, Artificial sequence
  Synthetic Oligonucleotide
tatttgtaatcaaaatagaa

SEQ ID NO: 1643 - DNA, 20 bp, Artificial sequence
  Synthetic Oligonucleotide
tactatttgtaatcaaaata

SEQ ID NO: 1644 - DNA, 20 bp, Artificial sequence
  Synthetic Oligonucleotide
ttttactatttgtaatcaaa

SEQ ID NO: 1645 - DNA, 20 bp, Artificial sequence
  Synthetic Oligonucleotide
gcttattttactatttgtaa

SEQ ID NO: 1646 - DNA, 20 bp, Artificial sequence
  Synthetic Oligonucleotide
cttgcttattttactatttg

SEQ ID NO: 1647 - DNA, 20 bp, Artificial sequence
  Synthetic Oligonucleotide
ttatcttgcttattttacta

SEQ ID NO: 1648 - DNA, 20 bp, Artificial sequence
  Synthetic Oligonucleotide
gttattttatcttgcttatt

SEQ ID NO: 1649 - DNA, 20 bp, Artificial sequence
  Synthetic Oligonucleotide
aaacatctgttattttatct

SEQ ID NO: 1650 - DNA, 20 bp, Artificial sequence
  Synthetic Oligonucleotide
ggattttaaacatctgttat

SEQ ID NO: 1651 - DNA, 20 bp, Artificial sequence
  Synthetic Oligonucleotide
ctttttggattttaaacatc

SEQ ID NO: 1652 - DNA, 20 bp, Artificial sequence
  Synthetic Oligonucleotide
gtgctttttggattttaaac

SEQ ID NO: 1653 - DNA, 20 bp, Artificial sequence
  Synthetic Oligonucleotide
ttttgtatgtgctttttgga

SEQ ID NO: 1654 - DNA, 20 bp, Artificial sequence
  Synthetic Oligonucleotide
taagtgagtacttagacatc

SEQ ID NO: 1655 - DNA, 20 bp, Artificial sequence
  Synthetic Oligonucleotide
tactttataagtgagtactt

SEQ ID NO: 1656 - DNA, 20 bp, Artificial sequence
  Synthetic Oligonucleotide
ttctactttataagtgagta

SEQ ID NO: 1657 - DNA, 20 bp, Artificial sequence
  Synthetic Oligonucleotide
aatgtcttctactttataag

SEQ ID NO: 1658 - DNA, 20 bp, Artificial sequence
  Synthetic Oligonucleotide
aataatgaatgtcttctact

SEQ ID NO: 1659 - DNA, 20 bp, Artificial sequence
  Synthetic Oligonucleotide
tataataatgaatgtcttct

SEQ ID NO: 1660 - DNA, 20 bp, Artificial sequence
  Synthetic Oligonucleotide
tgatataataatgaatgtct

SEQ ID NO: 1661 - DNA, 20 bp, Artificial sequence
  Synthetic Oligonucleotide
aaaatttgatataataatga

SEQ ID NO: 1662 - DNA, 20 bp, Artificial sequence
  Synthetic Oligonucleotide
catttaaaaatttgatataa

SEQ ID NO: 1663 - DNA, 20 bp, Artificial sequence
  Synthetic Oligonucleotide
gtactgagcatttaaaaatt

SEQ ID NO: 1664 - DNA, 20 bp, Artificial sequence
  Synthetic Oligonucleotide
aatggtcaaatagtactgag

SEQ ID NO: 1665 - DNA, 20 bp, Artificial sequence
  Synthetic Oligonucleotide
ttaaatggtcaaatagtact

SEQ ID NO: 1666 - DNA, 20 bp, Artificial sequence
  Synthetic Oligonucleotide
agtttgaatacaaaattttt

SEQ ID NO: 1667 - DNA, 20 bp, Artificial sequence
  Synthetic Oligonucleotide
actggtagtttgaatacaaa

SEQ ID NO: 1668 - DNA, 20 bp, Artificial sequence
  Synthetic Oligonucleotide
ttcactggtagtttgaatac

SEQ ID NO: 1669 - DNA, 20 bp, Artificial sequence
  Synthetic Oligonucleotide
gctttcactggtagtttgaa

SEQ ID NO: 1670 - DNA, 20 bp, Artificial sequence
  Synthetic Oligonucleotide
agggctttcactggtagttt

SEQ ID NO: 1671 - DNA, 20 bp, Artificial sequence
  Synthetic Oligonucleotide
ggtagggctttcactggtag

SEQ ID NO: 1672 - DNA, 20 bp, Artificial sequence
  Synthetic Oligonucleotide
ctaggtagggctttcactgg

SEQ ID NO: 1673 - DNA, 20 bp, Artificial sequence
  Synthetic Oligonucleotide
cttctaggtagggctttcac

SEQ ID NO: 1674 - DNA, 20 bp, Artificial sequence
  Synthetic Oligonucleotide
taccttctaggtagggcttt

SEQ ID NO: 1675 - DNA, 20 bp, Artificial sequence
  Synthetic Oligonucleotide
gtataccttctaggtagggc

SEQ ID NO: 1676 - DNA, 20 bp, Artificial sequence
  Synthetic Oligonucleotide
tgagtataccttctaggtag

SEQ ID NO: 1677 - DNA, 20 bp, Artificial sequence
  Synthetic Oligonucleotide
cactgagtataccttctagg

SEQ ID NO: 1678 - DNA, 20 bp, Artificial sequence
  Synthetic Oligonucleotide
tatcactgagtataccttct

SEQ ID NO: 1679 - DNA, 20 bp, Artificial sequence
  Synthetic Oligonucleotide
acttatcactgagtatacct

SEQ ID NO: 1680 - DNA, 20 bp, Artificial sequence
  Synthetic Oligonucleotide
acaaaacttatcactgagta

SEQ ID NO: 1681 - DNA, 20 bp, Artificial sequence
  Synthetic Oligonucleotide
gctacaaaacttatcactga

SEQ ID NO: 1682 - DNA, 20 bp, Artificial sequence
  Synthetic Oligonucleotide
ggagctacaaaacttatcac

SEQ ID NO: 1683 - DNA, 20 bp, Artificial sequence
  Synthetic Oligonucleotide
gatttggagctacaaaactt

SEQ ID NO: 1684 - DNA, 20 bp, Artificial sequence
  Synthetic Oligonucleotide
gaagatttggagctacaaaa

SEQ ID NO: 1685 - DNA, 20 bp, Artificial sequence
  Synthetic Oligonucleotide
ctattagaagatttggagct

SEQ ID NO: 1686 - DNA, 20 bp, Artificial sequence
  Synthetic Oligonucleotide
cactcactattagaagattt

SEQ ID NO: 1687 - DNA, 20 bp, Artificial sequence
  Synthetic Oligonucleotide
tgtcagccttttattttggg

SEQ ID NO: 1688 - DNA, 20 bp, Artificial sequence
  Synthetic Oligonucleotide
acctgtcagccttttatttt

SEQ ID NO: 1689 - DNA, 20 bp, Artificial sequence
  Synthetic Oligonucleotide
tcgacttacctgtcagcctt

SEQ ID NO: 1690 - DNA, 20 bp, Artificial sequence
  Synthetic Oligonucleotide
ttctcgacttacctgtcagc

SEQ ID NO: 1691 - DNA, 20 bp, Artificial sequence
  Synthetic Oligonucleotide
gtattctcgacttacctgtc

SEQ ID NO: 1692 - DNA, 20 bp, Artificial sequence
  Synthetic Oligonucleotide
taacatccatatacagtcaa

SEQ ID NO: 1693 - DNA, 20 bp, Artificial sequence
  Synthetic Oligonucleotide
tattaacatccatatacagt

SEQ ID NO: 1694 - DNA, 20 bp, Artificial sequence
  Synthetic Oligonucleotide
atttattaacatccatatac

SEQ ID NO: 1695 - DNA, 20 bp, Artificial sequence
  Synthetic Oligonucleotide
gctatttattaacatccata

SEQ ID NO: 1696 - DNA, 20 bp, Artificial sequence
  Synthetic Oligonucleotide
ctgtcagctatttattaaca

SEQ ID NO: 1697 - DNA, 20 bp, Artificial sequence
  Synthetic Oligonucleotide
ttactgtcagctatttatta

SEQ ID NO: 1698 - DNA, 20 bp, Artificial sequence
  Synthetic Oligonucleotide
actttactgtcagctattta

SEQ ID NO: 1699 - DNA, 20 bp, Artificial sequence
  Synthetic Oligonucleotide
taaactttactgtcagctat

SEQ ID NO: 1700 - DNA, 20 bp, Artificial sequence
  Synthetic Oligonucleotide
ggataaactttactgtcagc

SEQ ID NO: 1701 - DNA, 20 bp, Artificial sequence
  Synthetic Oligonucleotide
tatggataaactttactgtc

SEQ ID NO: 1702 - DNA, 20 bp, Artificial sequence
  Synthetic Oligonucleotide
ttatatggataaactttact

SEQ ID NO: 1703 - DNA, 20 bp, Artificial sequence
  Synthetic Oligonucleotide
ttgcaagtctttatatggat

SEQ ID NO: 1704 - DNA, 20 bp, Artificial sequence
  Synthetic Oligonucleotide
tatttgcaagtctttatatg

SEQ ID NO: 1705 - DNA, 20 bp, Artificial sequence
  Synthetic Oligonucleotide
gaatatttgcaagtctttat

SEQ ID NO: 1706 - DNA, 20 bp, Artificial sequence
  Synthetic Oligonucleotide
gtagaggaatatttgcaagt

SEQ ID NO: 1707 - DNA, 20 bp, Artificial sequence
  Synthetic Oligonucleotide
gttacattattatagatatt

SEQ ID NO: 1708 - DNA, 20 bp, Artificial sequence
  Synthetic Oligonucleotide
tgtgttacattattatagat

SEQ ID NO: 1709 - DNA, 20 bp, Artificial sequence
  Synthetic Oligonucleotide
gaaatgtgttacattattat

SEQ ID NO: 1710 - DNA, 20 bp, Artificial sequence
  Synthetic Oligonucleotide
ttcaccagtgaaatgtgtta

SEQ ID NO: 1711 - DNA, 20 bp, Artificial sequence
  Synthetic Oligonucleotide
tgtttcaccagtgaaatgtg

SEQ ID NO: 1712 - DNA, 20 bp, Artificial sequence
  Synthetic Oligonucleotide
acatgtttcaccagtgaaat

SEQ ID NO: 1713 - DNA, 20 bp, Artificial sequence
  Synthetic Oligonucleotide
aagacatgtttcaccagtga

SEQ ID NO: 1714 - DNA, 20 bp, Artificial sequence
  Synthetic Oligonucleotide
gacaagacatgtttcaccag

SEQ ID NO: 1715 - DNA, 20 bp, Artificial sequence
  Synthetic Oligonucleotide
tatgacaagacatgtttcac

SEQ ID NO: 1716 - DNA, 20 bp, Artificial sequence
  Synthetic Oligonucleotide
gcatatgacaagacatgttt

SEQ ID NO: 1717 - DNA, 20 bp, Artificial sequence
  Synthetic Oligonucleotide
taatgcatatgacaagacat

SEQ ID NO: 1718 - DNA, 20 bp, Artificial sequence
  Synthetic Oligonucleotide
ctataatgcatatgacaaga

SEQ ID NO: 1719 - DNA, 20 bp, Artificial sequence
  Synthetic Oligonucleotide
tttctataatgcatatgaca

SEQ ID NO: 1720 - DNA, 20 bp, Artificial sequence
  Synthetic Oligonucleotide
tcctttctataatgcatatg

SEQ ID NO: 1721 - DNA, 20 bp, Artificial sequence
  Synthetic Oligonucleotide
tctgattatcctttctataa

SEQ ID NO: 1722 - DNA, 20 bp, Artificial sequence
  Synthetic Oligonucleotide
aagtctgattatcctttcta

SEQ ID NO: 1723 - DNA, 20 bp, Artificial sequence
  Synthetic Oligonucleotide
aactgaaagtctgattatcc

SEQ ID NO: 1724 - DNA, 20 bp, Artificial sequence
  Synthetic Oligonucleotide
tataactgaaagtctgatta

SEQ ID NO: 1725 - DNA, 20 bp, Artificial sequence
  Synthetic Oligonucleotide
gttaaaaatattaatataac

SEQ ID NO: 1726 - DNA, 20 bp, Artificial sequence
  Synthetic Oligonucleotide
tgtgcacaaaaatgttaaaa

SEQ ID NO: 1727 - DNA, 20 bp, Artificial sequence
  Synthetic Oligonucleotide
ctatgtgcacaaaaatgtta

SEQ ID NO: 1728 - DNA, 20 bp, Artificial sequence
  Synthetic Oligonucleotide
tagctatgtgcacaaaaatg

SEQ ID NO: 1729 - DNA, 20 bp, Artificial sequence
  Synthetic Oligonucleotide
agatagctatgtgcacaaaa

SEQ ID NO: 1730 - DNA, 20 bp, Artificial sequence
  Synthetic Oligonucleotide
tgaagatagctatgtgcaca

SEQ ID NO: 1731 - DNA, 20 bp, Artificial sequence
  Synthetic Oligonucleotide
tattgaagatagctatgtgc

SEQ ID NO: 1732 - DNA, 20 bp, Artificial sequence
  Synthetic Oligonucleotide
ttttattgaagatagctatg

SEQ ID NO: 1733 - DNA, 20 bp, Artificial sequence
  Synthetic Oligonucleotide
caattttattgaagatagct

SEQ ID NO: 1734 - DNA, 20 bp, Artificial sequence
  Synthetic Oligonucleotide
aaacaattttattgaagata

SEQ ID NO: 1735 - DNA, 20 bp, Artificial sequence
  Synthetic Oligonucleotide
gtgtatcttaaaataatacc

SEQ ID NO: 1736 - DNA, 20 bp, Artificial sequence
  Synthetic Oligonucleotide
ttagtgtatcttaaaataat

SEQ ID NO: 1737 - DNA, 20 bp, Artificial sequence
  Synthetic Oligonucleotide
tgatcattttagtgtatctt

SEQ ID NO: 1738 - DNA, 20 bp, Artificial sequence
  Synthetic Oligonucleotide
cccttgatcattttagtgta

SEQ ID NO: 1739 - DNA, 20 bp, Artificial sequence
  Synthetic Oligonucleotide
aatcccttgatcattttagt

SEQ ID NO: 1740 - DNA, 20 bp, Artificial sequence
  Synthetic Oligonucleotide
ttgaatcccttgatcatttt

SEQ ID NO: 1741 - DNA, 20 bp, Artificial sequence
  Synthetic Oligonucleotide
ttagtcttgaatcccttgat

SEQ ID NO: 1742 - DNA, 20 bp, Artificial sequence
  Synthetic Oligonucleotide
ttgtttagtcttgaatccct

SEQ ID NO: 1743 - DNA, 20 bp, Artificial sequence
  Synthetic Oligonucleotide
gagttgtttagtcttgaatc

SEQ ID NO: 1744 - DNA, 20 bp, Artificial sequence
  Synthetic Oligonucleotide
attgagttgtttagtcttga

SEQ ID NO: 1745 - DNA, 20 bp, Artificial sequence
  Synthetic Oligonucleotide
ctaattgagttgtttagtct

SEQ ID NO: 1746 - DNA, 20 bp, Artificial sequence
  Synthetic Oligonucleotide
caactaattgagttgtttag

SEQ ID NO: 1747 - DNA, 20 bp, Artificial sequence
  Synthetic Oligonucleotide
attggtgcaactaattgagt

SEQ ID NO: 1748 - DNA, 20 bp, Artificial sequence
  Synthetic Oligonucleotide
tttattggtgcaactaattg

SEQ ID NO: 1749 - DNA, 20 bp, Artificial sequence
  Synthetic Oligonucleotide
ttttttattggtgcaactaa

SEQ ID NO: 1750 - DNA, 20 bp, Artificial sequence
  Synthetic Oligonucleotide
taagtgttttttattggtgc

SEQ ID NO: 1751 - DNA, 20 bp, Artificial sequence
  Synthetic Oligonucleotide
actgacagtttttttaagtg

SEQ ID NO: 1752 - DNA, 20 bp, Artificial sequence
  Synthetic Oligonucleotide
gacactgacagtttttttaa

SEQ ID NO: 1753 - DNA, 20 bp, Artificial sequence
  Synthetic Oligonucleotide
ttggacactgacagtttttt

SEQ ID NO: 1754 - DNA, 20 bp, Artificial sequence
  Synthetic Oligonucleotide
aggttggacactgacagttt

SEQ ID NO: 1755 - DNA, 20 bp, Artificial sequence
  Synthetic Oligonucleotide
tacaggttggacactgacag

SEQ ID NO: 1756 - DNA, 20 bp, Artificial sequence
  Synthetic Oligonucleotide
tatattggataatttgaaat

SEQ ID NO: 1757 - DNA, 20 bp, Artificial sequence
  Synthetic Oligonucleotide
atgtatattggataatttga

SEQ ID NO: 1758 - DNA, 20 bp, Artificial sequence
  Synthetic Oligonucleotide
gacatgtatattggataatt

SEQ ID NO: 1759 - DNA, 20 bp, Artificial sequence
  Synthetic Oligonucleotide
atgacatgtatattggataa

SEQ ID NO: 1760 - DNA, 20 bp, Artificial sequence
  Synthetic Oligonucleotide
tatatatgacatgtatattg

SEQ ID NO: 1761 - DNA, 20 bp, Artificial sequence
  Synthetic Oligonucleotide
atgtgacatataaaaatata

SEQ ID NO: 1762 - DNA, 20 bp, Artificial sequence
  Synthetic Oligonucleotide
atatgtgacatataaaaata

SEQ ID NO: 1763 - DNA, 20 bp, Artificial sequence
  Synthetic Oligonucleotide
tttatatatgtgacatataa

SEQ ID NO: 1764 - DNA, 20 bp, Artificial sequence
  Synthetic Oligonucleotide
cttttatatatgtgacatat

SEQ ID NO: 1765 - DNA, 20 bp, Artificial sequence
  Synthetic Oligonucleotide
atcttttatatatgtgacat

SEQ ID NO: 1766 - DNA, 20 bp, Artificial sequence
  Synthetic Oligonucleotide
catatcttttatatatgtga

SEQ ID NO: 1767 - DNA, 20 bp, Artificial sequence
  Synthetic Oligonucleotide
tcatacatatcttttatata

SEQ ID NO: 1768 - DNA, 20 bp, Artificial sequence
  Synthetic Oligonucleotide
tagatcatacatatctttta

SEQ ID NO: 1769 - DNA, 20 bp, Artificial sequence
  Synthetic Oligonucleotide
catagatcatacatatcttt

SEQ ID NO: 1770 - DNA, 20 bp, Artificial sequence
  Synthetic Oligonucleotide
cacatagatcatacatatct

SEQ ID NO: 1771 - DNA, 20 bp, Artificial sequence
  Synthetic Oligonucleotide
aggattcacatagatcatac

SEQ ID NO: 1772 - DNA, 20 bp, Artificial sequence
  Synthetic Oligonucleotide
ttaggattcacatagatcat

SEQ ID NO: 1773 - DNA, 20 bp, Artificial sequence
  Synthetic Oligonucleotide
acttaggattcacatagatc

SEQ ID NO: 1774 - DNA, 20 bp, Artificial sequence
  Synthetic Oligonucleotide
ttacttaggattcacataga

SEQ ID NO: 1775 - DNA, 20 bp, Artificial sequence
  Synthetic Oligonucleotide
tatttacttaggattcacat

SEQ ID NO: 1776 - DNA, 20 bp, Artificial sequence
  Synthetic Oligonucleotide
aatatttacttaggattcac

SEQ ID NO: 1777 - DNA, 20 bp, Artificial sequence
  Synthetic Oligonucleotide
tgtacttttctggaacaaaa

SEQ ID NO: 1778 - DNA, 20 bp, Artificial sequence
  Synthetic Oligonucleotide
gattatttttacctttatta

SEQ ID NO: 1779 - DNA, 20 bp, Artificial sequence
  Synthetic Oligonucleotide
tagattatttttacctttat

SEQ ID NO: 1780 - DNA, 20 bp, Artificial sequence
  Synthetic Oligonucleotide
attatagattatttttacct

SEQ ID NO: 1781 - DNA, 20 bp, Artificial sequence
  Synthetic Oligonucleotide
gaaaattatagattattttt

SEQ ID NO: 1782 - DNA, 20 bp, Artificial sequence
  Synthetic Oligonucleotide
ggtcctgaaaattatagatt

SEQ ID NO: 1783 - DNA, 20 bp, Artificial sequence
  Synthetic Oligonucleotide
gtggtcctgaaaattataga

SEQ ID NO: 1784 - DNA, 20 bp, Artificial sequence
  Synthetic Oligonucleotide
ctgtggtcctgaaaattata

SEQ ID NO: 1785 - DNA, 20 bp, Artificial sequence
  Synthetic Oligonucleotide
gtctgtggtcctgaaaatta

SEQ ID NO: 1786 - DNA, 20 bp, Artificial sequence
  Synthetic Oligonucleotide
tcgacagcttagtctgtggt

SEQ ID NO: 1787 - DNA, 20 bp, Artificial sequence
  Synthetic Oligonucleotide
tttcgacagcttagtctgtg

SEQ ID NO: 1788 - DNA, 20 bp, Artificial sequence
  Synthetic Oligonucleotide
aatttcgacagcttagtctg

SEQ ID NO: 1789 - DNA, 20 bp, Artificial sequence
  Synthetic Oligonucleotide
ttaatttcgacagcttagtc

SEQ ID NO: 1790 - DNA, 20 bp, Artificial sequence
  Synthetic Oligonucleotide
cgttaatttcgacagcttag

SEQ ID NO: 1791 - DNA, 20 bp, Artificial sequence
  Synthetic Oligonucleotide
tggccctaaaaaaatcagcg

SEQ ID NO: 1792 - DNA, 20 bp, Artificial sequence
  Synthetic Oligonucleotide
tctggccctaaaaaaatcag

SEQ ID NO: 1793 - DNA, 20 bp, Artificial sequence
  Synthetic Oligonucleotide
tggtattctggccctaaaaa

SEQ ID NO: 1794 - DNA, 20 bp, Artificial sequence
  Synthetic Oligonucleotide
tttggtattctggccctaaa

SEQ ID NO: 1795 - DNA, 20 bp, Artificial sequence
  Synthetic Oligonucleotide
ccattttggtattctggccc

SEQ ID NO: 1796 - DNA, 20 bp, Artificial sequence
  Synthetic Oligonucleotide
gaggagccattttggtattc

SEQ ID NO: 1797 - DNA, 20 bp, Artificial sequence
  Synthetic Oligonucleotide
gagaggagccattttggtat

SEQ ID NO: 1798 - DNA, 20 bp, Artificial sequence
  Synthetic Oligonucleotide
aagagaggagccattttggt

SEQ ID NO: 1799 - DNA, 20 bp, Artificial sequence
  Synthetic Oligonucleotide
tgaaattgtccaattttggg

SEQ ID NO: 1800 - DNA, 20 bp, Artificial sequence
  Synthetic Oligonucleotide
tttgaaattgtccaattttg

SEQ ID NO: 1801 - DNA, 20 bp, Artificial sequence
  Synthetic Oligonucleotide
catttgaaattgtccaattt

SEQ ID NO: 1802 - DNA, 20 bp, Artificial sequence
  Synthetic Oligonucleotide
tgcatttgaaattgtccaat

SEQ ID NO: 1803 - DNA, 20 bp, Artificial sequence
  Synthetic Oligonucleotide
attttgcatttgaaattgtc

SEQ ID NO: 1804 - DNA, 20 bp, Artificial sequence
  Synthetic Oligonucleotide
ataatgaattattttgcatt

SEQ ID NO: 1805 - DNA, 20 bp, Artificial sequence
  Synthetic Oligonucleotide
taaataatgaattattttgc

SEQ ID NO: 1806 - DNA, 20 bp, Artificial sequence
  Synthetic Oligonucleotide
ctcatatattaaataatgaa

SEQ ID NO: 1807 - DNA, 20 bp, Artificial sequence
  Synthetic Oligonucleotide
aactcatatattaaataatg

SEQ ID NO: 1808 - DNA, 20 bp, Artificial sequence
  Synthetic Oligonucleotide
tagaggaagcaactcatata

SEQ ID NO: 1809 - DNA, 20 bp, Artificial sequence
  Synthetic Oligonucleotide
aatagaggaagcaactcata

SEQ ID NO: 1810 - DNA, 20 bp, Artificial sequence
  Synthetic Oligonucleotide
caaatagaggaagcaactca

SEQ ID NO: 1811 - DNA, 20 bp, Artificial sequence
  Synthetic Oligonucleotide
accaaatagaggaagcaact

SEQ ID NO: 1812 - DNA, 20 bp, Artificial sequence
  Synthetic Oligonucleotide
aaaccaaatagaggaagcaa

SEQ ID NO: 1813 - DNA, 20 bp, Artificial sequence
  Synthetic Oligonucleotide
ggaaaccaaatagaggaagc

SEQ ID NO: 1814 - DNA, 20 bp, Artificial sequence
  Synthetic Oligonucleotide
taaggaaaccaaatagagga

SEQ ID NO: 1815 - DNA, 20 bp, Artificial sequence
  Synthetic Oligonucleotide
tttaaggaaaccaaatagag

SEQ ID NO: 1816 - DNA, 20 bp, Artificial sequence
  Synthetic Oligonucleotide
tgttttcttctggaagcaga

SEQ ID NO: 1817 - DNA, 20 bp, Artificial sequence
  Synthetic Oligonucleotide
cttactttaagtgaagttac

SEQ ID NO: 1818 - DNA, 20 bp, Artificial sequence
  Synthetic Oligonucleotide
ttttctacttactttaagtg

SEQ ID NO: 1819 - DNA, 20 bp, Artificial sequence
  Synthetic Oligonucleotide
acatgaaccctctttatttt

SEQ ID NO: 1820 - DNA, 20 bp, Artificial sequence
  Synthetic Oligonucleotide
gaaaacataaacatgaaccc

SEQ ID NO: 1821 - DNA, 20 bp, Artificial sequence
  Synthetic Oligonucleotide
agatccacattgaaaacata

SEQ ID NO: 1822 - DNA, 20 bp, Artificial sequence
  Synthetic Oligonucleotide
ttaaaagatccacattgaaa

SEQ ID NO: 1823 - DNA, 20 bp, Artificial sequence
  Synthetic Oligonucleotide
gccttagaaatatttttttt

SEQ ID NO: 1824 - DNA, 20 bp, Artificial sequence
  Synthetic Oligonucleotide
caaatggcatgccttagaaa

SEQ ID NO: 1825 - DNA, 20 bp, Artificial sequence
  Synthetic Oligonucleotide
tatttcaaatggcatgcctt

SEQ ID NO: 1826 - DNA, 20 bp, Artificial sequence
  Synthetic Oligonucleotide
caaagtatttcaaatggcat

SEQ ID NO: 1827 - DNA, 20 bp, Artificial sequence
  Synthetic Oligonucleotide
tgcaacaaagtatttcaaat

SEQ ID NO: 1828 - DNA, 20 bp, Artificial sequence
  Synthetic Oligonucleotide
tcaacaatgcaacaaagtat

SEQ ID NO: 1829 - DNA, 20 bp, Artificial sequence
  Synthetic Oligonucleotide
gaaaaaaaagtatttcaaca

SEQ ID NO: 1830 - DNA, 20 bp, Artificial sequence
  Synthetic Oligonucleotide
gattatttttcttggaaaaa

SEQ ID NO: 1831 - DNA, 20 bp, Artificial sequence
  Synthetic Oligonucleotide
gaaattttattttctggaga

SEQ ID NO: 1832 - DNA, 20 bp, Artificial sequence
  Synthetic Oligonucleotide
aaattataataggaaatttt

SEQ ID NO: 1833 - DNA, 20 bp, Artificial sequence
  Synthetic Oligonucleotide
ctgaatataatgaatgaaat

SEQ ID NO: 1834 - DNA, 20 bp, Artificial sequence
  Synthetic Oligonucleotide
tacctgaatataatgaatga

SEQ ID NO: 1835 - DNA, 20 bp, Artificial sequence
  Synthetic Oligonucleotide
gactacctgaatataatgaa

SEQ ID NO: 1836 - DNA, 20 bp, Artificial sequence
  Synthetic Oligonucleotide
atggactacctgaatataat

SEQ ID NO: 1837 - DNA, 20 bp, Artificial sequence
  Synthetic Oligonucleotide
tccatggactacctgaatat

SEQ ID NO: 1838 - DNA, 20 bp, Artificial sequence
  Synthetic Oligonucleotide
accatcaagcctcccaaaac

SEQ ID NO: 1839 - DNA, 20 bp, Artificial sequence
  Synthetic Oligonucleotide
ccttaccatcaagcctccca

SEQ ID NO: 1840 - DNA, 20 bp, Artificial sequence
  Synthetic Oligonucleotide
agtccccttaccatcaagcc

SEQ ID NO: 1841 - DNA, 20 bp, Artificial sequence
  Synthetic Oligonucleotide
tgtagtccccttaccatcaa

SEQ ID NO: 1842 - DNA, 20 bp, Artificial sequence
  Synthetic Oligonucleotide
gaatgtagtccccttaccat

SEQ ID NO: 1843 - DNA, 20 bp, Artificial sequence
  Synthetic Oligonucleotide
attgaatgtagtccccttac

SEQ ID NO: 1844 - DNA, 20 bp, Artificial sequence
  Synthetic Oligonucleotide
atgattgaatgtagtcccct

SEQ ID NO: 1845 - DNA, 20 bp, Artificial sequence
  Synthetic Oligonucleotide
gattagcaagtgaatgaatg

SEQ ID NO: 1846 - DNA, 20 bp, Artificial sequence
  Synthetic Oligonucleotide
gtagattagcaagtgaatga

SEQ ID NO: 1847 - DNA, 20 bp, Artificial sequence
  Synthetic Oligonucleotide
tttgtagattagcaagtgaa

SEQ ID NO: 1848 - DNA, 20 bp, Artificial sequence
  Synthetic Oligonucleotide
atatttgtagattagcaagt

SEQ ID NO: 1849 - DNA, 20 bp, Artificial sequence
  Synthetic Oligonucleotide
ccataagaggttctcagtaa

SEQ ID NO: 1850 - DNA, 20 bp, Artificial sequence
  Synthetic Oligonucleotide
ggtccataagaggttctcag

SEQ ID NO: 1851 - DNA, 20 bp, Artificial sequence
  Synthetic Oligonucleotide
cctggtccataagaggttct

SEQ ID NO: 1852 - DNA, 20 bp, Artificial sequence
  Synthetic Oligonucleotide
taatacctggtccataagag

SEQ ID NO: 1853 - DNA, 20 bp, Artificial sequence
  Synthetic Oligonucleotide
tcctaatacctggtccataa

SEQ ID NO: 1854 - DNA, 20 bp, Artificial sequence
  Synthetic Oligonucleotide
ttttcctaatacctggtcca

SEQ ID NO: 1855 - DNA, 20 bp, Artificial sequence
  Synthetic Oligonucleotide
tacttttcctaatacctggt

SEQ ID NO: 1856 - DNA, 20 bp, Artificial sequence
  Synthetic Oligonucleotide
cgttactacttttcctaata

SEQ ID NO: 1857 - DNA, 20 bp, Artificial sequence
  Synthetic Oligonucleotide
aaggctgagactgcttctcg

SEQ ID NO: 1858 - DNA, 20 bp, Artificial sequence
  Synthetic Oligonucleotide
gataataaattatatgaagg

SEQ ID NO: 1859 - DNA, 20 bp, Artificial sequence
  Synthetic Oligonucleotide
gtttgataataaattatatg

SEQ ID NO: 1860 - DNA, 20 bp, Artificial sequence
  Synthetic Oligonucleotide
gtgtaattgtttgataataa

SEQ ID NO: 1861 - DNA, 20 bp, Artificial sequence
  Synthetic Oligonucleotide
aatgtgtaattgtttgataa

SEQ ID NO: 1862 - DNA, 20 bp, Artificial sequence
  Synthetic Oligonucleotide
gtaatttactaacaaatgtg

SEQ ID NO: 1863 - DNA, 20 bp, Artificial sequence
  Synthetic Oligonucleotide
agtgtaatttactaacaaat

SEQ ID NO: 1864 - DNA, 20 bp, Artificial sequence
  Synthetic Oligonucleotide
ataagtgtaatttactaaca

SEQ ID NO: 1865 - DNA, 20 bp, Artificial sequence
  Synthetic Oligonucleotide
gtaataagtgtaatttacta

SEQ ID NO: 1866 - DNA, 20 bp, Artificial sequence
  Synthetic Oligonucleotide
gttgtaataagtgtaattta

SEQ ID NO: 1867 - DNA, 20 bp, Artificial sequence
  Synthetic Oligonucleotide
acagttgtaataagtgtaat

SEQ ID NO: 1868 - DNA, 20 bp, Artificial sequence
  Synthetic Oligonucleotide
ataacagttgtaataagtgt

SEQ ID NO: 1869 - DNA, 20 bp, Artificial sequence
  Synthetic Oligonucleotide
ttcaaataataacagttgta

SEQ ID NO: 1870 - DNA, 20 bp, Artificial sequence
  Synthetic Oligonucleotide
ataattcaaataataacagt

SEQ ID NO: 1871 - DNA, 20 bp, Artificial sequence
  Synthetic Oligonucleotide
aattgtgataaatataattc

SEQ ID NO: 1872 - DNA, 20 bp, Artificial sequence
  Synthetic Oligonucleotide
atgtaattgtgataaatata

SEQ ID NO: 1873 - DNA, 20 bp, Artificial sequence
  Synthetic Oligonucleotide
gacatgtaattgtgataaat

SEQ ID NO: 1874 - DNA, 20 bp, Artificial sequence
  Synthetic Oligonucleotide
acagacatgtaattgtgata

SEQ ID NO: 1875 - DNA, 20 bp, Artificial sequence
  Synthetic Oligonucleotide
agaacagacatgtaattgtg

SEQ ID NO: 1876 - DNA, 20 bp, Artificial sequence
  Synthetic Oligonucleotide
ttaagaacagacatgtaatt

SEQ ID NO: 1877 - DNA, 20 bp, Artificial sequence
  Synthetic Oligonucleotide
aagtatatttaagaacagac

SEQ ID NO: 1878 - DNA, 20 bp, Artificial sequence
  Synthetic Oligonucleotide
ttaaattgtgataagtatat

SEQ ID NO: 1879 - DNA, 20 bp, Artificial sequence
  Synthetic Oligonucleotide
gaattaaattgtgataagta

SEQ ID NO: 1880 - DNA, 20 bp, Artificial sequence
  Synthetic Oligonucleotide
gtggaattaaattgtgataa

SEQ ID NO: 1881 - DNA, 20 bp, Artificial sequence
  Synthetic Oligonucleotide
gccgtggaattaaattgtga

SEQ ID NO: 1882 - DNA, 20 bp, Artificial sequence
  Synthetic Oligonucleotide
taagccgtggaattaaattg

SEQ ID NO: 1883 - DNA, 20 bp, Artificial sequence
  Synthetic Oligonucleotide
ttgtaagccgtggaattaaa

SEQ ID NO: 1884 - DNA, 20 bp, Artificial sequence
  Synthetic Oligonucleotide
tcattgtaagccgtggaatt

SEQ ID NO: 1885 - DNA, 20 bp, Artificial sequence
  Synthetic Oligonucleotide
tgatcattgtaagccgtgga

SEQ ID NO: 1886 - DNA, 20 bp, Artificial sequence
  Synthetic Oligonucleotide
tatagttatgatcattgtaa

SEQ ID NO: 1887 - DNA, 20 bp, Artificial sequence
  Synthetic Oligonucleotide
aattatagttatgatcattg

SEQ ID NO: 1888 - DNA, 20 bp, Artificial sequence
  Synthetic Oligonucleotide
ctttaataattatagttatg

SEQ ID NO: 1889 - DNA, 20 bp, Artificial sequence
  Synthetic Oligonucleotide
tgtctttaataattatagtt

SEQ ID NO: 1890 - DNA, 20 bp, Artificial sequence
  Synthetic Oligonucleotide
aattgtctttaataattata

SEQ ID NO: 1891 - DNA, 20 bp, Artificial sequence
  Synthetic Oligonucleotide
tcaaaattgtctttaataat

SEQ ID NO: 1892 - DNA, 20 bp, Artificial sequence
  Synthetic Oligonucleotide
atttaatcaaaattgtcttt

SEQ ID NO: 1893 - DNA, 20 bp, Artificial sequence
  Synthetic Oligonucleotide
taacatttaatcaaaattgt

SEQ ID NO: 1894 - DNA, 20 bp, Artificial sequence
  Synthetic Oligonucleotide
acataacatttaatcaaaat

SEQ ID NO: 1895 - DNA, 20 bp, Artificial sequence
  Synthetic Oligonucleotide
atgacataacatttaatcaa

SEQ ID NO: 1896 - DNA, 20 bp, Artificial sequence
  Synthetic Oligonucleotide
tacttatgacataacattta

SEQ ID NO: 1897 - DNA, 20 bp, Artificial sequence
  Synthetic Oligonucleotide
ttactacttatgacataaca

SEQ ID NO: 1898 - DNA, 20 bp, Artificial sequence
  Synthetic Oligonucleotide
aacagttactacttatgaca

SEQ ID NO: 1899 - DNA, 20 bp, Artificial sequence
  Synthetic Oligonucleotide
tgtaacagttactacttatg

SEQ ID NO: 1900 - DNA, 20 bp, Artificial sequence
  Synthetic Oligonucleotide
cttatttgtaacagttacta

SEQ ID NO: 1901 - DNA, 20 bp, Artificial sequence
  Synthetic Oligonucleotide
tttcacagcttatttgtaac

SEQ ID NO: 1902 - DNA, 20 bp, Artificial sequence
  Synthetic Oligonucleotide
tcttttcacagcttatttgt

SEQ ID NO: 1903 - DNA, 20 bp, Artificial sequence
  Synthetic Oligonucleotide
ggttcttttcacagcttatt

SEQ ID NO: 1904 - DNA, 20 bp, Artificial sequence
  Synthetic Oligonucleotide
ctaggagtggttcttttcac

SEQ ID NO: 1905 - DNA, 20 bp, Artificial sequence
  Synthetic Oligonucleotide
atgctaggagtggttctttt

SEQ ID NO: 1906 - DNA, 20 bp, Artificial sequence
  Synthetic Oligonucleotide
ctaatgctaggagtggttct

SEQ ID NO: 1907 - DNA, 20 bp, Artificial sequence
  Synthetic Oligonucleotide
agagtgactaatgctaggag

SEQ ID NO: 1908 - DNA, 20 bp, Artificial sequence
  Synthetic Oligonucleotide
agagaatagagtgactaatg

SEQ ID NO: 1909 - DNA, 20 bp, Artificial sequence
  Synthetic Oligonucleotide
ttaatgagagaatagagtga

SEQ ID NO: 1910 - DNA, 20 bp, Artificial sequence
  Synthetic Oligonucleotide
ctgttggtttaattgtttat

SEQ ID NO: 1911 - DNA, 20 bp, Artificial sequence
  Synthetic Oligonucleotide
tgctgttggtttaattgttt

SEQ ID NO: 1912 - DNA, 20 bp, Artificial sequence
  Synthetic Oligonucleotide
tatgctgttggtttaattgt

SEQ ID NO: 1913 - DNA, 20 bp, Artificial sequence
  Synthetic Oligonucleotide
actatgctgttggtttaatt

SEQ ID NO: 1914 - DNA, 20 bp, Artificial sequence
  Synthetic Oligonucleotide
tgactatgctgttggtttaa

SEQ ID NO: 1915 - DNA, 20 bp, Artificial sequence
  Synthetic Oligonucleotide
atttgactatgctgttggtt

SEQ ID NO: 1916 - DNA, 20 bp, Artificial sequence
  Synthetic Oligonucleotide
ttatttgactatgctgttgg

SEQ ID NO: 1917 - DNA, 20 bp, Artificial sequence
  Synthetic Oligonucleotide
ttttatttgactatgctgtt

SEQ ID NO: 1918 - DNA, 20 bp, Artificial sequence
  Synthetic Oligonucleotide
tcttttatttgactatgctg

SEQ ID NO: 1919 - DNA, 20 bp, Artificial sequence
  Synthetic Oligonucleotide
tttcttttatttgactatgc

SEQ ID NO: 1920 - DNA, 20 bp, Artificial sequence
  Synthetic Oligonucleotide
cttctgagctgattttctat

SEQ ID NO: 1921 - DNA, 20 bp, Artificial sequence
  Synthetic Oligonucleotide
tccttctgagctgattttct

SEQ ID NO: 1922 - DNA, 20 bp, Artificial sequence
  Synthetic Oligonucleotide
agtccttctgagctgatttt

SEQ ID NO: 1923 - DNA, 20 bp, Artificial sequence
  Synthetic Oligonucleotide
ctagtccttctgagctgatt

SEQ ID NO: 1924 - DNA, 20 bp, Artificial sequence
  Synthetic Oligonucleotide
tactagtccttctgagctga

SEQ ID NO: 1925 - DNA, 20 bp, Artificial sequence
  Synthetic Oligonucleotide
aatactagtccttctgagct

SEQ ID NO: 1926 - DNA, 20 bp, Artificial sequence
  Synthetic Oligonucleotide
tgaatactagtccttctgag

SEQ ID NO: 1927 - DNA, 20 bp, Artificial sequence
  Synthetic Oligonucleotide
cttgaatactagtccttctg

SEQ ID NO: 1928 - DNA, 20 bp, Artificial sequence
  Synthetic Oligonucleotide
ttcttgaatactagtccttc

SEQ ID NO: 1929 - DNA, 20 bp, Artificial sequence
  Synthetic Oligonucleotide
tgggttcttgaatactagtc

SEQ ID NO: 1930 - DNA, 20 bp, Artificial sequence
  Synthetic Oligonucleotide
tgtgggttcttgaatactag

SEQ ID NO: 1931 - DNA, 20 bp, Artificial sequence
  Synthetic Oligonucleotide
tctgtgggttcttgaatact

SEQ ID NO: 1932 - DNA, 20 bp, Artificial sequence
  Synthetic Oligonucleotide
tagagaaatttctgtgggtt

SEQ ID NO: 1933 - DNA, 20 bp, Artificial sequence
  Synthetic Oligonucleotide
aagatagagaaatttctgtg

SEQ ID NO: 1934 - DNA, 20 bp, Artificial sequence
  Synthetic Oligonucleotide
ggaagatagagaaatttctg

SEQ ID NO: 1935 - DNA, 20 bp, Artificial sequence
  Synthetic Oligonucleotide
cttggcttggaagatagaga

SEQ ID NO: 1936 - DNA, 20 bp, Artificial sequence
  Synthetic Oligonucleotide
ctcttggcttggaagataga

SEQ ID NO: 1937 - DNA, 20 bp, Artificial sequence
  Synthetic Oligonucleotide
aagggagtagttcttggtgc

SEQ ID NO: 1938 - DNA, 20 bp, Artificial sequence
  Synthetic Oligonucleotide
aaagggagtagttcttggtg

SEQ ID NO: 1939 - DNA, 20 bp, Artificial sequence
  Synthetic Oligonucleotide
gaaagggagtagttcttggt

SEQ ID NO: 1940 - DNA, 20 bp, Artificial sequence
  Synthetic Oligonucleotide
agaaagggagtagttcttgg

SEQ ID NO: 1941 - DNA, 20 bp, Artificial sequence
  Synthetic Oligonucleotide
aagaaagggagtagttcttg

SEQ ID NO: 1942 - DNA, 20 bp, Artificial sequence
  Synthetic Oligonucleotide
gaagaaagggagtagttctt

SEQ ID NO: 1943 - DNA, 20 bp, Artificial sequence
  Synthetic Oligonucleotide
tcaactgaagaaagggagta

SEQ ID NO: 1944 - DNA, 20 bp, Artificial sequence
  Synthetic Oligonucleotide
attcaactgaagaaagggag

SEQ ID NO: 1945 - DNA, 20 bp, Artificial sequence
  Synthetic Oligonucleotide
cattcaactgaagaaaggga

SEQ ID NO: 1946 - DNA, 20 bp, Artificial sequence
  Synthetic Oligonucleotide
tcattcaactgaagaaaggg

SEQ ID NO: 1947 - DNA, 20 bp, Artificial sequence
  Synthetic Oligonucleotide
tttcattcaactgaagaaag

SEQ ID NO: 1948 - DNA, 20 bp, Artificial sequence
  Synthetic Oligonucleotide
atttcattcaactgaagaaa

SEQ ID NO: 1949 - DNA, 20 bp, Artificial sequence
  Synthetic Oligonucleotide
tatttcattcaactgaagaa

SEQ ID NO: 1950 - DNA, 20 bp, Artificial sequence
  Synthetic Oligonucleotide
ttatttcattcaactgaaga

SEQ ID NO: 1951 - DNA, 20 bp, Artificial sequence
  Synthetic Oligonucleotide
cttatttcattcaactgaag

SEQ ID NO: 1952 - DNA, 20 bp, Artificial sequence
  Synthetic Oligonucleotide
tcttatttcattcaactgaa

SEQ ID NO: 1953 - DNA, 20 bp, Artificial sequence
  Synthetic Oligonucleotide
ttcttatttcattcaactga

SEQ ID NO: 1954 - DNA, 20 bp, Artificial sequence
  Synthetic Oligonucleotide
atttcttatttcattcaact

SEQ ID NO: 1955 - DNA, 20 bp, Artificial sequence
  Synthetic Oligonucleotide
tacatttcttatttcattca

SEQ ID NO: 1956 - DNA, 20 bp, Artificial sequence
  Synthetic Oligonucleotide
ttcagcaggaatgccatcat

SEQ ID NO: 1957 - DNA, 20 bp, Artificial sequence
  Synthetic Oligonucleotide
attcagcaggaatgccatca

SEQ ID NO: 1958 - DNA, 20 bp, Artificial sequence
  Synthetic Oligonucleotide
cattcagcaggaatgccatc

SEQ ID NO: 1959 - DNA, 20 bp, Artificial sequence
  Synthetic Oligonucleotide
acattcagcaggaatgccat

SEQ ID NO: 1960 - DNA, 20 bp, Artificial sequence
  Synthetic Oligonucleotide
tacattcagcaggaatgcca

SEQ ID NO: 1961 - DNA, 20 bp, Artificial sequence
  Synthetic Oligonucleotide
gtacattcagcaggaatgcc

SEQ ID NO: 1962 - DNA, 20 bp, Artificial sequence
  Synthetic Oligonucleotide
tggtacattcagcaggaatg

SEQ ID NO: 1963 - DNA, 20 bp, Artificial sequence
  Synthetic Oligonucleotide
gtggtacattcagcaggaat

SEQ ID NO: 1964 - DNA, 20 bp, Artificial sequence
  Synthetic Oligonucleotide
ggtggtacattcagcaggaa

SEQ ID NO: 1965 - DNA, 20 bp, Artificial sequence
  Synthetic Oligonucleotide
tggtggtacattcagcagga

SEQ ID NO: 1966 - DNA, 20 bp, Artificial sequence
  Synthetic Oligonucleotide
atggtggtacattcagcagg

SEQ ID NO: 1967 - DNA, 20 bp, Artificial sequence
  Synthetic Oligonucleotide
aatggtggtacattcagcag

SEQ ID NO: 1968 - DNA, 20 bp, Artificial sequence
  Synthetic Oligonucleotide
aaatggtggtacattcagca

SEQ ID NO: 1969 - DNA, 20 bp, Artificial sequence
  Synthetic Oligonucleotide
taaatggtggtacattcagc

SEQ ID NO: 1970 - DNA, 20 bp, Artificial sequence
  Synthetic Oligonucleotide
tataaatggtggtacattca

SEQ ID NO: 1971 - DNA, 20 bp, Artificial sequence
  Synthetic Oligonucleotide
ttataaatggtggtacattc

SEQ ID NO: 1972 - DNA, 20 bp, Artificial sequence
  Synthetic Oligonucleotide
gttataaatggtggtacatt

SEQ ID NO: 1973 - DNA, 20 bp, Artificial sequence
  Synthetic Oligonucleotide
tgttataaatggtggtacat

SEQ ID NO: 1974 - DNA, 20 bp, Artificial sequence
  Synthetic Oligonucleotide
ctgttataaatggtggtaca

SEQ ID NO: 1975 - DNA, 20 bp, Artificial sequence
  Synthetic Oligonucleotide
tctgttataaatggtggtac

SEQ ID NO: 1976 - DNA, 20 bp, Artificial sequence
  Synthetic Oligonucleotide
cacctctgttataaatggtg

SEQ ID NO: 1977 - DNA, 20 bp, Artificial sequence
  Synthetic Oligonucleotide
tcacctctgttataaatggt

SEQ ID NO: 1978 - DNA, 20 bp, Artificial sequence
  Synthetic Oligonucleotide
ttcacctctgttataaatgg

SEQ ID NO: 1979 - DNA, 20 bp, Artificial sequence
  Synthetic Oligonucleotide
gttcacctctgttataaatg

SEQ ID NO: 1980 - DNA, 20 bp, Artificial sequence
  Synthetic Oligonucleotide
atgttcacctctgttataaa

SEQ ID NO: 1981 - DNA, 20 bp, Artificial sequence
  Synthetic Oligonucleotide
tatgttcacctctgttataa

SEQ ID NO: 1982 - DNA, 20 bp, Artificial sequence
  Synthetic Oligonucleotide
gtatgttcacctctgttata

SEQ ID NO: 1983 - DNA, 20 bp, Artificial sequence
  Synthetic Oligonucleotide
tgtatgttcacctctgttat

SEQ ID NO: 1984 - DNA, 20 bp, Artificial sequence
  Synthetic Oligonucleotide
taatcgcaactagatgtagc

SEQ ID NO: 1985 - DNA, 20 bp, Artificial sequence
  Synthetic Oligonucleotide
gtaatcgcaactagatgtag

SEQ ID NO: 1986 - DNA, 20 bp, Artificial sequence
  Synthetic Oligonucleotide
agtaatcgcaactagatgta

SEQ ID NO: 1987 - DNA, 20 bp, Artificial sequence
  Synthetic Oligonucleotide
cagtaatcgcaactagatgt

SEQ ID NO: 1988 - DNA, 20 bp, Artificial sequence
  Synthetic Oligonucleotide
ccagtaatcgcaactagatg

SEQ ID NO: 1989 - DNA, 20 bp, Artificial sequence
  Synthetic Oligonucleotide
gccagtaatcgcaactagat

SEQ ID NO: 1990 - DNA, 20 bp, Artificial sequence
  Synthetic Oligonucleotide
tgccagtaatcgcaactaga

SEQ ID NO: 1991 - DNA, 20 bp, Artificial sequence
  Synthetic Oligonucleotide
ttgccagtaatcgcaactag

SEQ ID NO: 1992 - DNA, 20 bp, Artificial sequence
  Synthetic Oligonucleotide
attgccagtaatcgcaacta

SEQ ID NO: 1993 - DNA, 20 bp, Artificial sequence
  Synthetic Oligonucleotide
cattgccagtaatcgcaact

SEQ ID NO: 1994 - DNA, 20 bp, Artificial sequence
  Synthetic Oligonucleotide
acattgccagtaatcgcaac

SEQ ID NO: 1995 - DNA, 20 bp, Artificial sequence
  Synthetic Oligonucleotide
gacattgccagtaatcgcaa

SEQ ID NO: 1996 - DNA, 20 bp, Artificial sequence
  Synthetic Oligonucleotide
gggacattgccagtaatcgc

SEQ ID NO: 1997 - DNA, 20 bp, Artificial sequence
  Synthetic Oligonucleotide
ttgttttccgggattgcatt

SEQ ID NO: 1998 - DNA, 20 bp, Artificial sequence
  Synthetic Oligonucleotide
tttgttttccgggattgcat

SEQ ID NO: 1999 - DNA, 20 bp, Artificial sequence
  Synthetic Oligonucleotide
aatctttgttttccgggatt

SEQ ID NO: 2000 - DNA, 20 bp, Artificial sequence
  Synthetic Oligonucleotide
aaatctttgttttccgggat

SEQ ID NO: 2001 - DNA, 20 bp, Artificial sequence
  Synthetic Oligonucleotide
aaacaccaaatctttgtttt

SEQ ID NO: 2002 - DNA, 20 bp, Artificial sequence
  Synthetic Oligonucleotide
aaaacaccaaatctttgttt

SEQ ID NO: 2003 - DNA, 20 bp, Artificial sequence
  Synthetic Oligonucleotide
gtagaaaacaccaaatcttt

SEQ ID NO: 2004 - DNA, 20 bp, Artificial sequence
  Synthetic Oligonucleotide
agtagaaaacaccaaatctt

SEQ ID NO: 2005 - DNA, 20 bp, Artificial sequence
  Synthetic Oligonucleotide
cccaagtagaaaacaccaaa

SEQ ID NO: 2006 - DNA, 20 bp, Artificial sequence
  Synthetic Oligonucleotide
tcccaagtagaaaacaccaa

SEQ ID NO: 2007 - DNA, 20 bp, Artificial sequence
  Synthetic Oligonucleotide
gtgatcccaagtagaaaaca

SEQ ID NO: 2008 - DNA, 20 bp, Artificial sequence
  Synthetic Oligonucleotide
tgtgatcccaagtagaaaac

SEQ ID NO: 2009 - DNA, 20 bp, Artificial sequence
  Synthetic Oligonucleotide
ttgtgatcccaagtagaaaa

SEQ ID NO: 2010 - DNA, 20 bp, Artificial sequence
  Synthetic Oligonucleotide
tttgtgatcccaagtagaaa

SEQ ID NO: 2011 - DNA, 20 bp, Artificial sequence
  Synthetic Oligonucleotide
cttttgctttgtgatcccaa

SEQ ID NO: 2012 - DNA, 20 bp, Artificial sequence
  Synthetic Oligonucleotide
tgtccttttgctttgtgatc

SEQ ID NO: 2013 - DNA, 20 bp, Artificial sequence
  Synthetic Oligonucleotide
gtgtccttttgctttgtgat

SEQ ID NO: 2014 - DNA, 20 bp, Artificial sequence
  Synthetic Oligonucleotide
agtgtccttttgctttgtga

SEQ ID NO: 2015 - DNA, 20 bp, Artificial sequence
  Synthetic Oligonucleotide
ttgaagtgtccttttgcttt

SEQ ID NO: 2016 - DNA, 20 bp, Artificial sequence
  Synthetic Oligonucleotide
gttgaagtgtccttttgctt

SEQ ID NO: 2017 - DNA, 20 bp, Artificial sequence
  Synthetic Oligonucleotide
agttgaagtgtccttttgct

SEQ ID NO: 2018 - DNA, 20 bp, Artificial sequence
  Synthetic Oligonucleotide
cagttgaagtgtccttttgc

SEQ ID NO: 2019 - DNA, 20 bp, Artificial sequence
  Synthetic Oligonucleotide
acagttgaagtgtccttttg

SEQ ID NO: 2020 - DNA, 20 bp, Artificial sequence
  Synthetic Oligonucleotide
gacagttgaagtgtcctttt

SEQ ID NO: 2021 - DNA, 20 bp, Artificial sequence
  Synthetic Oligonucleotide
ggacagttgaagtgtccttt

SEQ ID NO: 2022 - DNA, 20 bp, Artificial sequence
  Synthetic Oligonucleotide
tggacagttgaagtgtcctt

SEQ ID NO: 2023 - DNA, 20 bp, Artificial sequence
  Synthetic Oligonucleotide
ctggacagttgaagtgtcct

SEQ ID NO: 2024 - DNA, 20 bp, Artificial sequence
  Synthetic Oligonucleotide
tctggacagttgaagtgtcc

SEQ ID NO: 2025 - DNA, 20 bp, Artificial sequence
  Synthetic Oligonucleotide
ctctggacagttgaagtgtc

SEQ ID NO: 2026 - DNA, 20 bp, Artificial sequence
  Synthetic Oligonucleotide
cctctggacagttgaagtgt

SEQ ID NO: 2027 - DNA, 20 bp, Artificial sequence
  Synthetic Oligonucleotide
ccctctggacagttgaagtg

SEQ ID NO: 2028 - DNA, 20 bp, Artificial sequence
  Synthetic Oligonucleotide
accctctggacagttgaagt

SEQ ID NO: 2029 - DNA, 20 bp, Artificial sequence
  Synthetic Oligonucleotide
aaccctctggacagttgaag

SEQ ID NO: 2030 - DNA, 20 bp, Artificial sequence
  Synthetic Oligonucleotide
taaccctctggacagttgaa

SEQ ID NO: 2031 - DNA, 20 bp, Artificial sequence
  Synthetic Oligonucleotide
ataaccctctggacagttga

SEQ ID NO: 2032 - DNA, 20 bp, Artificial sequence
  Synthetic Oligonucleotide
aataaccctctggacagttg

SEQ ID NO: 2033 - DNA, 20 bp, Artificial sequence
  Synthetic Oligonucleotide
gaataaccctctggacagtt

SEQ ID NO: 2034 - DNA, 20 bp, Artificial sequence
  Synthetic Oligonucleotide
tgaataaccctctggacagt

SEQ ID NO: 2035 - DNA, 20 bp, Artificial sequence
  Synthetic Oligonucleotide
ctgaataaccctctggacag

SEQ ID NO: 2036 - DNA, 20 bp, Artificial sequence
  Synthetic Oligonucleotide
cctgaataaccctctggaca

SEQ ID NO: 2037 - DNA, 20 bp, Artificial sequence
  Synthetic Oligonucleotide
tcctgaataaccctctggac

SEQ ID NO: 2038 - DNA, 20 bp, Artificial sequence
  Synthetic Oligonucleotide
ctcctgaataaccctctgga

SEQ ID NO: 2039 - DNA, 20 bp, Artificial sequence
  Synthetic Oligonucleotide
cctcctgaataaccctctgg

SEQ ID NO: 2040 - DNA, 20 bp, Artificial sequence
  Synthetic Oligonucleotide
gcctcctgaataaccctctg

SEQ ID NO: 2041 - DNA, 20 bp, Artificial sequence
  Synthetic Oligonucleotide
agcctcctgaataaccctct

SEQ ID NO: 2042 - DNA, 20 bp, Artificial sequence
  Synthetic Oligonucleotide
cagcctcctgaataaccctc

SEQ ID NO: 2043 - DNA, 20 bp, Artificial sequence
  Synthetic Oligonucleotide
ccagcctcctgaataaccct

SEQ ID NO: 2044 - DNA, 20 bp, Artificial sequence
  Synthetic Oligonucleotide
accagcctcctgaataaccc

SEQ ID NO: 2045 - DNA, 20 bp, Artificial sequence
  Synthetic Oligonucleotide
caccagcctcctgaataacc

SEQ ID NO: 2046 - DNA, 20 bp, Artificial sequence
  Synthetic Oligonucleotide
ccaccagcctcctgaataac

SEQ ID NO: 2047 - DNA, 20 bp, Artificial sequence
  Synthetic Oligonucleotide
accaccagcctcctgaataa

SEQ ID NO: 2048 - DNA, 20 bp, Artificial sequence
  Synthetic Oligonucleotide
caccaccagcctcctgaata

SEQ ID NO: 2049 - DNA, 20 bp, Artificial sequence
  Synthetic Oligonucleotide
ccaccaccagcctcctgaat

SEQ ID NO: 2050 - DNA, 20 bp, Artificial sequence
  Synthetic Oligonucleotide
catgccaccaccagcctcct

SEQ ID NO: 2051 - DNA, 20 bp, Artificial sequence
  Synthetic Oligonucleotide
atcatgccaccaccagcctc

SEQ ID NO: 2052 - DNA, 20 bp, Artificial sequence
  Synthetic Oligonucleotide
catcatgccaccaccagcct

SEQ ID NO: 2053 - DNA, 20 bp, Artificial sequence
  Synthetic Oligonucleotide
acactcatcatgccaccacc

SEQ ID NO: 2054 - DNA, 20 bp, Artificial sequence
  Synthetic Oligonucleotide
ttctccacactcatcatgcc

SEQ ID NO: 2055 - DNA, 20 bp, Artificial sequence
  Synthetic Oligonucleotide
ttttctccacactcatcatg

SEQ ID NO: 2056 - DNA, 20 bp, Artificial sequence
  Synthetic Oligonucleotide
gttttctccacactcatcat

SEQ ID NO: 2057 - DNA, 20 bp, Artificial sequence
  Synthetic Oligonucleotide
atttaagaactgtacaatta

SEQ ID NO: 2058 - DNA, 20 bp, Artificial sequence
  Synthetic Oligonucleotide
catttaagaactgtacaatt

SEQ ID NO: 2059 - DNA, 20 bp, Artificial sequence
  Synthetic Oligonucleotide
acatttaagaactgtacaat

SEQ ID NO: 2060 - DNA, 20 bp, Artificial sequence
  Synthetic Oligonucleotide
aacatttaagaactgtacaa

SEQ ID NO: 2061 - DNA, 20 bp, Artificial sequence
  Synthetic Oligonucleotide
caacatttaagaactgtaca

SEQ ID NO: 2062 - DNA, 20 bp, Artificial sequence
  Synthetic Oligonucleotide
acaacatttaagaactgtac

SEQ ID NO: 2063 - DNA, 20 bp, Artificial sequence
  Synthetic Oligonucleotide
tacaacatttaagaactgta

SEQ ID NO: 2064 - DNA, 20 bp, Artificial sequence
  Synthetic Oligonucleotide
ctacaacatttaagaactgt

SEQ ID NO: 2065 - DNA, 20 bp, Artificial sequence
  Synthetic Oligonucleotide
actacaacatttaagaactg

SEQ ID NO: 2066 - DNA, 20 bp, Artificial sequence
  Synthetic Oligonucleotide
tactacaacatttaagaact

SEQ ID NO: 2067 - DNA, 20 bp, Artificial sequence
  Synthetic Oligonucleotide
atactacaacatttaagaac

SEQ ID NO: 2068 - DNA, 20 bp, Artificial sequence
  Synthetic Oligonucleotide
aatactacaacatttaagaa

SEQ ID NO: 2069 - DNA, 20 bp, Artificial sequence
  Synthetic Oligonucleotide
taatactacaacatttaaga

SEQ ID NO: 2070 - DNA, 20 bp, Artificial sequence
  Synthetic Oligonucleotide
ttaatactacaacatttaag

SEQ ID NO: 2071 - DNA, 20 bp, Artificial sequence
  Synthetic Oligonucleotide
gaaattaatactacaacatt

SEQ ID NO: 2072 - DNA, 20 bp, Artificial sequence
  Synthetic Oligonucleotide
ttttgaaattaatactacaa

SEQ ID NO: 2073 - DNA, 20 bp, Artificial sequence
  Synthetic Oligonucleotide
gttttgaaattaatactaca

SEQ ID NO: 2074 - DNA, 20 bp, Artificial sequence
  Synthetic Oligonucleotide
agttttgaaattaatactac

SEQ ID NO: 2075 - DNA, 20 bp, Artificial sequence
  Synthetic Oligonucleotide
tagttttgaaattaatacta

SEQ ID NO: 2076 - DNA, 20 bp, Artificial sequence
  Synthetic Oligonucleotide
ttagttttgaaattaatact

SEQ ID NO: 2077 - DNA, 20 bp, Artificial sequence
  Synthetic Oligonucleotide
cgatttttagttttgaaatt

SEQ ID NO: 2078 - DNA, 20 bp, Artificial sequence
  Synthetic Oligonucleotide
acgatttttagttttgaaat

SEQ ID NO: 2079 - DNA, 20 bp, Artificial sequence
  Synthetic Oligonucleotide
gacgatttttagttttgaaa

SEQ ID NO: 2080 - DNA, 20 bp, Artificial sequence
  Synthetic Oligonucleotide
tgacgatttttagttttgaa

SEQ ID NO: 2081 - DNA, 20 bp, Artificial sequence
  Synthetic Oligonucleotide
ctgacgatttttagttttga

SEQ ID NO: 2082 - DNA, 20 bp, Artificial sequence
  Synthetic Oligonucleotide
tgctgacgatttttagtttt

SEQ ID NO: 2083 - DNA, 20 bp, Artificial sequence
  Synthetic Oligonucleotide
gtgctgacgatttttagttt

SEQ ID NO: 2084 - DNA, 20 bp, Artificial sequence
  Synthetic Oligonucleotide
tgtgctgacgatttttagtt

SEQ ID NO: 2085 - DNA, 20 bp, Artificial sequence
  Synthetic Oligonucleotide
ctgtgctgacgatttttagt

SEQ ID NO: 2086 - DNA, 20 bp, Artificial sequence
  Synthetic Oligonucleotide
tctgtgctgacgatttttag

SEQ ID NO: 2087 - DNA, 20 bp, Artificial sequence
  Synthetic Oligonucleotide
ctctgtgctgacgattttta

SEQ ID NO: 2088 - DNA, 20 bp, Artificial sequence
  Synthetic Oligonucleotide
actctgtgctgacgattttt

SEQ ID NO: 2089 - DNA, 20 bp, Artificial sequence
  Synthetic Oligonucleotide
tactctgtgctgacgatttt

SEQ ID NO: 2090 - DNA, 20 bp, Artificial sequence
  Synthetic Oligonucleotide
atactctgtgctgacgattt

SEQ ID NO: 2091 - DNA, 20 bp, Artificial sequence
  Synthetic Oligonucleotide
catactctgtgctgacgatt

SEQ ID NO: 2092 - DNA, 20 bp, Artificial sequence
  Synthetic Oligonucleotide
acatactctgtgctgacgat

SEQ ID NO: 2093 - DNA, 20 bp, Artificial sequence
  Synthetic Oligonucleotide
tttttacacatactctgtgc

SEQ ID NO: 2094 - DNA, 20 bp, Artificial sequence
  Synthetic Oligonucleotide
cagatttttacacatactct

SEQ ID NO: 2095 - DNA, 20 bp, Artificial sequence
  Synthetic Oligonucleotide
acagatttttacacatactc

SEQ ID NO: 2096 - DNA, 20 bp, Artificial sequence
  Synthetic Oligonucleotide
tacagatttttacacatact

SEQ ID NO: 2097 - DNA, 20 bp, Artificial sequence
  Synthetic Oligonucleotide
ttacagatttttacacatac

SEQ ID NO: 2098 - DNA, 20 bp, Artificial sequence
  Synthetic Oligonucleotide
tattacagatttttacacat

SEQ ID NO: 2099 - DNA, 20 bp, Artificial sequence
  Synthetic Oligonucleotide
tgtattacagatttttacac

SEQ ID NO: 2100 - DNA, 20 bp, Artificial sequence
  Synthetic Oligonucleotide
cagtttaaaaatttgtatta

SEQ ID NO: 2101 - DNA, 20 bp, Artificial sequence
  Synthetic Oligonucleotide
catcagtttaaaaatttgta

SEQ ID NO: 2102 - DNA, 20 bp, Artificial sequence
  Synthetic Oligonucleotide
aagcatcagtttaaaaattt

SEQ ID NO: 2103 - DNA, 20 bp, Artificial sequence
  Synthetic Oligonucleotide
gaagcatcagtttaaaaatt

SEQ ID NO: 2104 - DNA, 20 bp, Artificial sequence
  Synthetic Oligonucleotide
tagcaaaatgaagcatcagt

SEQ ID NO: 2105 - DNA, 20 bp, Artificial sequence
  Synthetic Oligonucleotide
gtagcaaaatgaagcatcag

SEQ ID NO: 2106 - DNA, 20 bp, Artificial sequence
  Synthetic Oligonucleotide
tgtagcaaaatgaagcatca

SEQ ID NO: 2107 - DNA, 20 bp, Artificial sequence
  Synthetic Oligonucleotide
ttgtagcaaaatgaagcatc

SEQ ID NO: 2108 - DNA, 20 bp, Artificial sequence
  Synthetic Oligonucleotide
tttgtagcaaaatgaagcat

SEQ ID NO: 2109 - DNA, 20 bp, Artificial sequence
  Synthetic Oligonucleotide
aacatttactccaaattatt

SEQ ID NO: 2110 - DNA, 20 bp, Artificial sequence
  Synthetic Oligonucleotide
caaacatttactccaaatta

SEQ ID NO: 2111 - DNA, 20 bp, Artificial sequence
  Synthetic Oligonucleotide
atcaaacatttactccaaat

SEQ ID NO: 2112 - DNA, 20 bp, Artificial sequence
  Synthetic Oligonucleotide
catatcaaacatttactcca

SEQ ID NO: 2113 - DNA, 20 bp, Artificial sequence
  Synthetic Oligonucleotide
tcatatcaaacatttactcc

SEQ ID NO: 2114 - DNA, 20 bp, Artificial sequence
  Synthetic Oligonucleotide
atcatatcaaacatttactc

SEQ ID NO: 2115 - DNA, 20 bp, Artificial sequence
  Synthetic Oligonucleotide
taaataaatcatatcaaaca

SEQ ID NO: 2116 - DNA, 20 bp, Artificial sequence
  Synthetic Oligonucleotide
tcataaataaatcatatcaa

SEQ ID NO: 2117 - DNA, 20 bp, Artificial sequence
  Synthetic Oligonucleotide
ttcataaataaatcatatca

SEQ ID NO: 2118 - DNA, 20 bp, Artificial sequence
  Synthetic Oligonucleotide
tttcataaataaatcatatc

SEQ ID NO: 2119 - DNA, 20 bp, Artificial sequence
  Synthetic Oligonucleotide
gtttcataaataaatcatat

SEQ ID NO: 2120 - DNA, 20 bp, Artificial sequence
  Synthetic Oligonucleotide
ggtttcataaataaatcata

SEQ ID NO: 2121 - DNA, 20 bp, Artificial sequence
  Synthetic Oligonucleotide
aggtttcataaataaatcat

SEQ ID NO: 2122 - DNA, 20 bp, Artificial sequence
  Synthetic Oligonucleotide
taggtttcataaataaatca

SEQ ID NO: 2123 - DNA, 20 bp, Artificial sequence
  Synthetic Oligonucleotide
attaggtttcataaataaat

SEQ ID NO: 2124 - DNA, 20 bp, Artificial sequence
  Synthetic Oligonucleotide
cattaggtttcataaataaa

SEQ ID NO: 2125 - DNA, 20 bp, Artificial sequence
  Synthetic Oligonucleotide
tcattaggtttcataaataa

SEQ ID NO: 2126 - DNA, 20 bp, Artificial sequence
  Synthetic Oligonucleotide
ttcattaggtttcataaata

SEQ ID NO: 2127 - DNA, 20 bp, Artificial sequence
  Synthetic Oligonucleotide
cttcattaggtttcataaat

SEQ ID NO: 2128 - DNA, 20 bp, Artificial sequence
  Synthetic Oligonucleotide
gcttcattaggtttcataaa

SEQ ID NO: 2129 - DNA, 20 bp, Artificial sequence
  Synthetic Oligonucleotide
ttctgcttcattaggtttca

SEQ ID NO: 2130 - DNA, 20 bp, Artificial sequence
  Synthetic Oligonucleotide
taattctgcttcattaggtt

SEQ ID NO: 2131 - DNA, 20 bp, Artificial sequence
  Synthetic Oligonucleotide
tatgtagttcttctcagttc

SEQ ID NO: 2132 - DNA, 20 bp, Artificial sequence
  Synthetic Oligonucleotide
tagtttatatgtagttcttc

SEQ ID NO: 2133 - DNA, 20 bp, Artificial sequence
  Synthetic Oligonucleotide
cttgtagtttatatgtagtt

SEQ ID NO: 2134 - DNA, 20 bp, Artificial sequence
  Synthetic Oligonucleotide
ttgacttgtagtttatatgt

SEQ ID NO: 2135 - DNA, 20 bp, Artificial sequence
  Synthetic Oligonucleotide
ttttgacttgtagtttatat

SEQ ID NO: 2136 - DNA, 20 bp, Artificial sequence
  Synthetic Oligonucleotide
atttttgacttgtagtttat

SEQ ID NO: 2137 - DNA, 20 bp, Artificial sequence
  Synthetic Oligonucleotide
tcttcatttttgacttgtag

SEQ ID NO: 2138 - DNA, 20 bp, Artificial sequence
  Synthetic Oligonucleotide
tacctcttcatttttgactt

SEQ ID NO: 2139 - DNA, 20 bp, Artificial sequence
  Synthetic Oligonucleotide
attctttacctcttcatttt

SEQ ID NO: 2140 - DNA, 20 bp, Artificial sequence
  Synthetic Oligonucleotide
caagtgacatattctttacc

SEQ ID NO: 2141 - DNA, 20 bp, Artificial sequence
  Synthetic Oligonucleotide
ttcaagtgacatattcttta

SEQ ID NO: 2142 - DNA, 20 bp, Artificial sequence
  Synthetic Oligonucleotide
ttgagttcaagtgacatatt

SEQ ID NO: 2143 - DNA, 20 bp, Artificial sequence
  Synthetic Oligonucleotide
agttgagttcaagtgacata

SEQ ID NO: 2144 - DNA, 20 bp, Artificial sequence
  Synthetic Oligonucleotide
tttgagttgagttcaagtga

SEQ ID NO: 2145 - DNA, 20 bp, Artificial sequence
  Synthetic Oligonucleotide
tttcaagttttgagttgagt

SEQ ID NO: 2146 - DNA, 20 bp, Artificial sequence
  Synthetic Oligonucleotide
gctttcaagttttgagttga

SEQ ID NO: 2147 - DNA, 20 bp, Artificial sequence
  Synthetic Oligonucleotide
aggctttcaagttttgagtt

SEQ ID NO: 2148 - DNA, 20 bp, Artificial sequence
  Synthetic Oligonucleotide
taggaggctttcaagttttg

SEQ ID NO: 2149 - DNA, 20 bp, Artificial sequence
  Synthetic Oligonucleotide
ttctaggaggctttcaagtt

SEQ ID NO: 2150 - DNA, 20 bp, Artificial sequence
  Synthetic Oligonucleotide
tcttctaggaggctttcaag

SEQ ID NO: 2151 - DNA, 20 bp, Artificial sequence
  Synthetic Oligonucleotide
gaattttttcttctaggagg

SEQ ID NO: 2152 - DNA, 20 bp, Artificial sequence
  Synthetic Oligonucleotide
aagtagaattttttcttcta

SEQ ID NO: 2153 - DNA, 20 bp, Artificial sequence
  Synthetic Oligonucleotide
tgaagtagaattttttcttc

SEQ ID NO: 2154 - DNA, 20 bp, Artificial sequence
  Synthetic Oligonucleotide
gttgaagtagaattttttct

SEQ ID NO: 2155 - DNA, 20 bp, Artificial sequence
  Synthetic Oligonucleotide
tttgttgaagtagaattttt

SEQ ID NO: 2156 - DNA, 20 bp, Artificial sequence
  Synthetic Oligonucleotide
tttttgttgaagtagaattt

SEQ ID NO: 2157 - DNA, 20 bp, Artificial sequence
  Synthetic Oligonucleotide
ttgctcttctaaatatttca

SEQ ID NO: 2158 - DNA, 20 bp, Artificial sequence
  Synthetic Oligonucleotide
agttgctcttctaaatattt

SEQ ID NO: 2159 - DNA, 20 bp, Artificial sequence
  Synthetic Oligonucleotide
ttagttgctcttctaaatat

SEQ ID NO: 2160 - DNA, 20 bp, Artificial sequence
  Synthetic Oligonucleotide
tagttagttgctcttctaaa

SEQ ID NO: 2161 - DNA, 20 bp, Artificial sequence
  Synthetic Oligonucleotide
taagttagttagttgctctt

SEQ ID NO: 2162 - DNA, 20 bp, Artificial sequence
  Synthetic Oligonucleotide
attaagttagttagttgctc

SEQ ID NO: 2163 - DNA, 20 bp, Artificial sequence
  Synthetic Oligonucleotide
gaattaagttagttagttgc

SEQ ID NO: 2164 - DNA, 20 bp, Artificial sequence
  Synthetic Oligonucleotide
ttgaattaagttagttagtt

SEQ ID NO: 2165 - DNA, 20 bp, Artificial sequence
  Synthetic Oligonucleotide
ttttgaattaagttagttag

SEQ ID NO: 2166 - DNA, 20 bp, Artificial sequence
  Synthetic Oligonucleotide
tgattttgaattaagttagt

SEQ ID NO: 2167 - DNA, 20 bp, Artificial sequence
  Synthetic Oligonucleotide
ggttgattttgaattaagtt

SEQ ID NO: 2168 - DNA, 20 bp, Artificial sequence
  Synthetic Oligonucleotide
agtttcaggttgattttgaa

SEQ ID NO: 2169 - DNA, 20 bp, Artificial sequence
  Synthetic Oligonucleotide
ctggagtttcaggttgattt

SEQ ID NO: 2170 - DNA, 20 bp, Artificial sequence
  Synthetic Oligonucleotide
ggtgttctggagtttcaggt

SEQ ID NO: 2171 - DNA, 20 bp, Artificial sequence
  Synthetic Oligonucleotide
tgggtgttctggagtttcag

SEQ ID NO: 2172 - DNA, 20 bp, Artificial sequence
  Synthetic Oligonucleotide
tctgggtgttctggagtttc

SEQ ID NO: 2173 - DNA, 20 bp, Artificial sequence
  Synthetic Oligonucleotide
cttctgggtgttctggagtt

SEQ ID NO: 2174 - DNA, 20 bp, Artificial sequence
  Synthetic Oligonucleotide
tacttctgggtgttctggag

SEQ ID NO: 2175 - DNA, 20 bp, Artificial sequence
  Synthetic Oligonucleotide
gttacttctgggtgttctgg

SEQ ID NO: 2176 - DNA, 20 bp, Artificial sequence
  Synthetic Oligonucleotide
aagttacttctgggtgttct

SEQ ID NO: 2177 - DNA, 20 bp, Artificial sequence
  Synthetic Oligonucleotide
gtgaagttacttctgggtgt

SEQ ID NO: 2178 - DNA, 20 bp, Artificial sequence
  Synthetic Oligonucleotide
ttttaagtgaagttacttct

SEQ ID NO: 2179 - DNA, 20 bp, Artificial sequence
  Synthetic Oligonucleotide
agttttaagtgaagttactt

SEQ ID NO: 2180 - DNA, 20 bp, Artificial sequence
  Synthetic Oligonucleotide
aaagttttaagtgaagttac

SEQ ID NO: 2181 - DNA, 20 bp, Artificial sequence
  Synthetic Oligonucleotide
acaaaagttttaagtgaagt

SEQ ID NO: 2182 - DNA, 20 bp, Artificial sequence
  Synthetic Oligonucleotide
ctacaaaagttttaagtgaa

SEQ ID NO: 2183 - DNA, 20 bp, Artificial sequence
  Synthetic Oligonucleotide
ttctacaaaagttttaagtg

SEQ ID NO: 2184 - DNA, 20 bp, Artificial sequence
  Synthetic Oligonucleotide
tgtttttctacaaaagtttt

SEQ ID NO: 2185 - DNA, 20 bp, Artificial sequence
  Synthetic Oligonucleotide
cttgtttttctacaaaagtt

SEQ ID NO: 2186 - DNA, 20 bp, Artificial sequence
  Synthetic Oligonucleotide
tattatcttgtttttctaca

SEQ ID NO: 2187 - DNA, 20 bp, Artificial sequence
  Synthetic Oligonucleotide
gatgctattatcttgttttt

SEQ ID NO: 2188 - DNA, 20 bp, Artificial sequence
  Synthetic Oligonucleotide
tttgatgctattatcttgtt

SEQ ID NO: 2189 - DNA, 20 bp, Artificial sequence
  Synthetic Oligonucleotide
tctttgatgctattatcttg

SEQ ID NO: 2190 - DNA, 20 bp, Artificial sequence
  Synthetic Oligonucleotide
gagaaggtctttgatgctat

SEQ ID NO: 2191 - DNA, 20 bp, Artificial sequence
  Synthetic Oligonucleotide
gtctggagaaggtctttgat

SEQ ID NO: 2192 - DNA, 20 bp, Artificial sequence
  Synthetic Oligonucleotide
cggtctggagaaggtctttg

SEQ ID NO: 2193 - DNA, 20 bp, Artificial sequence
  Synthetic Oligonucleotide
cacggtctggagaaggtctt

SEQ ID NO: 2194 - DNA, 20 bp, Artificial sequence
  Synthetic Oligonucleotide
tccacggtctggagaaggtc

SEQ ID NO: 2195 - DNA, 20 bp, Artificial sequence
  Synthetic Oligonucleotide
cttccacggtctggagaagg

SEQ ID NO: 2196 - DNA, 20 bp, Artificial sequence
  Synthetic Oligonucleotide
gtcttccacggtctggagaa

SEQ ID NO: 2197 - DNA, 20 bp, Artificial sequence
  Synthetic Oligonucleotide
tggtcttccacggtctggag

SEQ ID NO: 2198 - DNA, 20 bp, Artificial sequence
  Synthetic Oligonucleotide
attggtcttccacggtctgg

SEQ ID NO: 2199 - DNA, 20 bp, Artificial sequence
  Synthetic Oligonucleotide
atattggtcttccacggtct

SEQ ID NO: 2200 - DNA, 20 bp, Artificial sequence
  Synthetic Oligonucleotide
ttatattggtcttccacggt

SEQ ID NO: 2201 - DNA, 20 bp, Artificial sequence
  Synthetic Oligonucleotide
gtttatattggtcttccacg

SEQ ID NO: 2202 - DNA, 20 bp, Artificial sequence
  Synthetic Oligonucleotide
ttgtttatattggtcttcca

SEQ ID NO: 2203 - DNA, 20 bp, Artificial sequence
  Synthetic Oligonucleotide
aattgtttatattggtcttc

SEQ ID NO: 2204 - DNA, 20 bp, Artificial sequence
  Synthetic Oligonucleotide
ttaattgtttatattggtct

SEQ ID NO: 2205 - DNA, 20 bp, Artificial sequence
  Synthetic Oligonucleotide
gtttaattgtttatattggt

SEQ ID NO: 2206 - DNA, 20 bp, Artificial sequence
  Synthetic Oligonucleotide
tggtttaattgtttatattg

SEQ ID NO: 2207 - DNA, 20 bp, Artificial sequence
  Synthetic Oligonucleotide
gttggtttaattgtttatat

SEQ ID NO: 2208 - DNA, 20 bp, Artificial sequence
  Synthetic Oligonucleotide
tttgtgatccatctattcga

SEQ ID NO: 2209 - DNA, 20 bp, Artificial sequence
  Synthetic Oligonucleotide
ttttgtgatccatctattcg

SEQ ID NO: 2210 - DNA, 20 bp, Artificial sequence
  Synthetic Oligonucleotide
attgaagttttgtgatccat

SEQ ID NO: 2211 - DNA, 20 bp, Artificial sequence
  Synthetic Oligonucleotide
cattgaagttttgtgatcca

SEQ ID NO: 2212 - DNA, 20 bp, Artificial sequence
  Synthetic Oligonucleotide
tcattgaagttttgtgatcc

SEQ ID NO: 2213 - DNA, 20 bp, Artificial sequence
  Synthetic Oligonucleotide
ttcattgaagttttgtgatc

SEQ ID NO: 2214 - DNA, 20 bp, Artificial sequence
  Synthetic Oligonucleotide
tttcattgaagttttgtgat

SEQ ID NO: 2215 - DNA, 20 bp, Artificial sequence
  Synthetic Oligonucleotide
atatttgtagttctcccacg

SEQ ID NO: 2216 - DNA, 20 bp, Artificial sequence
  Synthetic Oligonucleotide
ccaaaaccatatttgtagtt

SEQ ID NO: 2217 - DNA, 20 bp, Artificial sequence
  Synthetic Oligonucleotide
cccaaaaccatatttgtagt

SEQ ID NO: 2218 - DNA, 20 bp, Artificial sequence
  Synthetic Oligonucleotide
tcccaaaaccatatttgtag

SEQ ID NO: 2219 - DNA, 20 bp, Artificial sequence
  Synthetic Oligonucleotide
ctcccaaaaccatatttgta

SEQ ID NO: 2220 - DNA, 20 bp, Artificial sequence
  Synthetic Oligonucleotide
agcctcccaaaaccatattt

SEQ ID NO: 2221 - DNA, 20 bp, Artificial sequence
  Synthetic Oligonucleotide
caagcctcccaaaaccatat

SEQ ID NO: 2222 - DNA, 20 bp, Artificial sequence
  Synthetic Oligonucleotide
tcaagcctcccaaaaccata

SEQ ID NO: 2223 - DNA, 20 bp, Artificial sequence
  Synthetic Oligonucleotide
atcaagcctcccaaaaccat

SEQ ID NO: 2224 - DNA, 20 bp, Artificial sequence
  Synthetic Oligonucleotide
catcaagcctcccaaaacca

SEQ ID NO: 2225 - DNA, 20 bp, Artificial sequence
  Synthetic Oligonucleotide
ccatcaagcctcccaaaacc

SEQ ID NO: 2226 - DNA, 20 bp, Artificial sequence
  Synthetic Oligonucleotide
tccatcaagcctcccaaaac

SEQ ID NO: 2227 - DNA, 20 bp, Artificial sequence
  Synthetic Oligonucleotide
ctccatcaagcctcccaaaa

SEQ ID NO: 2228 - DNA, 20 bp, Artificial sequence
  Synthetic Oligonucleotide
aaaattctccatcaagcctc

SEQ ID NO: 2229 - DNA, 20 bp, Artificial sequence
  Synthetic Oligonucleotide
ccaaaattctccatcaagcc

SEQ ID NO: 2230 - DNA, 20 bp, Artificial sequence
  Synthetic Oligonucleotide
accaaaattctccatcaagc

SEQ ID NO: 2231 - DNA, 20 bp, Artificial sequence
  Synthetic Oligonucleotide
ccaaccaaaattctccatca

SEQ ID NO: 2232 - DNA, 20 bp, Artificial sequence
  Synthetic Oligonucleotide
cccaaccaaaattctccatc

SEQ ID NO: 2233 - DNA, 20 bp, Artificial sequence
  Synthetic Oligonucleotide
gcccaaccaaaattctccat

SEQ ID NO: 2234 - DNA, 20 bp, Artificial sequence
  Synthetic Oligonucleotide
ggcccaaccaaaattctcca

SEQ ID NO: 2235 - DNA, 20 bp, Artificial sequence
  Synthetic Oligonucleotide
aggcccaaccaaaattctcc

SEQ ID NO: 2236 - DNA, 20 bp, Artificial sequence
  Synthetic Oligonucleotide
taggcccaaccaaaattctc

SEQ ID NO: 2237 - DNA, 20 bp, Artificial sequence
  Synthetic Oligonucleotide
ctaggcccaaccaaaattct

SEQ ID NO: 2238 - DNA, 20 bp, Artificial sequence
  Synthetic Oligonucleotide
tctaggcccaaccaaaattc

SEQ ID NO: 2239 - DNA, 20 bp, Artificial sequence
  Synthetic Oligonucleotide
ctctaggcccaaccaaaatt

SEQ ID NO: 2240 - DNA, 20 bp, Artificial sequence
  Synthetic Oligonucleotide
tctctaggcccaaccaaaat

SEQ ID NO: 2241 - DNA, 20 bp, Artificial sequence
  Synthetic Oligonucleotide
ttctctaggcccaaccaaaa

SEQ ID NO: 2242 - DNA, 20 bp, Artificial sequence
  Synthetic Oligonucleotide
cttctctaggcccaaccaaa

SEQ ID NO: 2243 - DNA, 20 bp, Artificial sequence
  Synthetic Oligonucleotide
atatcttctctaggcccaac

SEQ ID NO: 2244 - DNA, 20 bp, Artificial sequence
  Synthetic Oligonucleotide
tatatcttctctaggcccaa

SEQ ID NO: 2245 - DNA, 20 bp, Artificial sequence
  Synthetic Oligonucleotide
gtatatcttctctaggccca

SEQ ID NO: 2246 - DNA, 20 bp, Artificial sequence
  Synthetic Oligonucleotide
atggagtatatcttctctag

SEQ ID NO: 2247 - DNA, 20 bp, Artificial sequence
  Synthetic Oligonucleotide
cactatggagtatatcttct

SEQ ID NO: 2248 - DNA, 20 bp, Artificial sequence
  Synthetic Oligonucleotide
tcactatggagtatatcttc

SEQ ID NO: 2249 - DNA, 20 bp, Artificial sequence
  Synthetic Oligonucleotide
ttcactatggagtatatctt

SEQ ID NO: 2250 - DNA, 20 bp, Artificial sequence
  Synthetic Oligonucleotide
ttgcttcactatggagtata

SEQ ID NO: 2251 - DNA, 20 bp, Artificial sequence
  Synthetic Oligonucleotide
attgcttcactatggagtat

SEQ ID NO: 2252 - DNA, 20 bp, Artificial sequence
  Synthetic Oligonucleotide
ttagattgcttcactatgga

SEQ ID NO: 2253 - DNA, 20 bp, Artificial sequence
  Synthetic Oligonucleotide
attagattgcttcactatgg

SEQ ID NO: 2254 - DNA, 20 bp, Artificial sequence
  Synthetic Oligonucleotide
aattagattgcttcactatg

SEQ ID NO: 2255 - DNA, 20 bp, Artificial sequence
  Synthetic Oligonucleotide
taattagattgcttcactat

SEQ ID NO: 2256 - DNA, 20 bp, Artificial sequence
  Synthetic Oligonucleotide
ataattagattgcttcacta

SEQ ID NO: 2257 - DNA, 20 bp, Artificial sequence
  Synthetic Oligonucleotide
cataattagattgcttcact

SEQ ID NO: 2258 - DNA, 20 bp, Artificial sequence
  Synthetic Oligonucleotide
acataattagattgcttcac

SEQ ID NO: 2259 - DNA, 20 bp, Artificial sequence
  Synthetic Oligonucleotide
aacataattagattgcttca

SEQ ID NO: 2260 - DNA, 20 bp, Artificial sequence
  Synthetic Oligonucleotide
aaacataattagattgcttc

SEQ ID NO: 2261 - DNA, 20 bp, Artificial sequence
  Synthetic Oligonucleotide
aaaacataattagattgctt

SEQ ID NO: 2262 - DNA, 20 bp, Artificial sequence
  Synthetic Oligonucleotide
taaaacataattagattgct

SEQ ID NO: 2263 - DNA, 20 bp, Artificial sequence
  Synthetic Oligonucleotide
gtaaaacataattagattgc

SEQ ID NO: 2264 - DNA, 20 bp, Artificial sequence
  Synthetic Oligonucleotide
cgtaaaacataattagattg

SEQ ID NO: 2265 - DNA, 20 bp, Artificial sequence
  Synthetic Oligonucleotide
ttccagtcttccaactcaat

SEQ ID NO: 2266 - DNA, 20 bp, Artificial sequence
  Synthetic Oligonucleotide
ctttccagtcttccaactca

SEQ ID NO: 2267 - DNA, 20 bp, Artificial sequence
  Synthetic Oligonucleotide
ttgttgtctttccagtcttc

SEQ ID NO: 2268 - DNA, 20 bp, Artificial sequence
  Synthetic Oligonucleotide
ataatgtttgttgtctttcc

SEQ ID NO: 2269 - DNA, 20 bp, Artificial sequence
  Synthetic Oligonucleotide
tataatgtttgttgtctttc

SEQ ID NO: 2270 - DNA, 20 bp, Artificial sequence
  Synthetic Oligonucleotide
atataatgtttgttgtcttt

SEQ ID NO: 2271 - DNA, 20 bp, Artificial sequence
  Synthetic Oligonucleotide
tcaatataatgtttgttgtc

SEQ ID NO: 2272 - DNA, 20 bp, Artificial sequence
  Synthetic Oligonucleotide
atattcaatataatgtttgt

SEQ ID NO: 2273 - DNA, 20 bp, Artificial sequence
  Synthetic Oligonucleotide
aatattcaatataatgtttg

SEQ ID NO: 2274 - DNA, 20 bp, Artificial sequence
  Synthetic Oligonucleotide
gaatattcaatataatgttt

SEQ ID NO: 2275 - DNA, 20 bp, Artificial sequence
  Synthetic Oligonucleotide
agaatattcaatataatgtt

SEQ ID NO: 2276 - DNA, 20 bp, Artificial sequence
  Synthetic Oligonucleotide
aagaatattcaatataatgt

SEQ ID NO: 2277 - DNA, 20 bp, Artificial sequence
  Synthetic Oligonucleotide
caagtaaaaagaatattcaa

SEQ ID NO: 2278 - DNA, 20 bp, Artificial sequence
  Synthetic Oligonucleotide
ccaagtaaaaagaatattca

SEQ ID NO: 2279 - DNA, 20 bp, Artificial sequence
  Synthetic Oligonucleotide
cccaagtaaaaagaatattc

SEQ ID NO: 2280 - DNA, 20 bp, Artificial sequence
  Synthetic Oligonucleotide
tttcccaagtaaaaagaata

SEQ ID NO: 2281 - DNA, 20 bp, Artificial sequence
  Synthetic Oligonucleotide
atttcccaagtaaaaagaat

SEQ ID NO: 2282 - DNA, 20 bp, Artificial sequence
  Synthetic Oligonucleotide
gatttcccaagtaaaaagaa

SEQ ID NO: 2283 - DNA, 20 bp, Artificial sequence
  Synthetic Oligonucleotide
tgatttcccaagtaaaaaga

SEQ ID NO: 2284 - DNA, 20 bp, Artificial sequence
  Synthetic Oligonucleotide
aatcgcaactagatgtagcg

SEQ ID NO: 2285 - DNA, 20 bp, Artificial sequence
  Synthetic Oligonucleotide
attctttaaggttatgtgat

SEQ ID NO: 2286 - DNA, 20 bp, Artificial sequence
  Synthetic Oligonucleotide
tattctttaaggttatgtga

SEQ ID NO: 2287 - DNA, 20 bp, Artificial sequence
  Synthetic Oligonucleotide
acggtattctttaaggttat

SEQ ID NO: 2288 - DNA, 20 bp, Artificial sequence
  Synthetic Oligonucleotide
aacggtattctttaaggtta

SEQ ID NO: 2289 - DNA, 20 bp, Artificial sequence
  Synthetic Oligonucleotide
aaacggtattctttaaggtt

SEQ ID NO: 2290 - DNA, 20 bp, Artificial sequence
  Synthetic Oligonucleotide
taaacggtattctttaaggt

SEQ ID NO: 2291 - DNA, 20 bp, Artificial sequence
  Synthetic Oligonucleotide
gtaaacggtattctttaagg

SEQ ID NO: 2292 - DNA, 20 bp, Artificial sequence
  Synthetic Oligonucleotide
tgtaaacggtattctttaag

SEQ ID NO: 2293 - DNA, 20 bp, Artificial sequence
  Synthetic Oligonucleotide
atgtaaacggtattctttaa

SEQ ID NO: 2294 - DNA, 20 bp, Artificial sequence
  Synthetic Oligonucleotide
aatgtaaacggtattcttta

SEQ ID NO: 2295 - DNA, 20 bp, Artificial sequence
  Synthetic Oligonucleotide
aaatgtaaacggtattcttt

SEQ ID NO: 2296 - DNA, 20 bp, Artificial sequence
  Synthetic Oligonucleotide
gaaatgtaaacggtattctt

SEQ ID NO: 2297 - DNA, 20 bp, Artificial sequence
  Synthetic Oligonucleotide
agaaatgtaaacggtattct

SEQ ID NO: 2298 - DNA, 20 bp, Artificial sequence
  Synthetic Oligonucleotide
gagaaatgtaaacggtattc

SEQ ID NO: 2299 - DNA, 20 bp, Artificial sequence
  Synthetic Oligonucleotide
tgagaaatgtaaacggtatt

SEQ ID NO: 2300 - DNA, 20 bp, Artificial sequence
  Synthetic Oligonucleotide
ttgagaaatgtaaacggtat

SEQ ID NO: 2301 - DNA, 20 bp, Artificial sequence
  Synthetic Oligonucleotide
attgagaaatgtaaacggta

SEQ ID NO: 2302 - DNA, 20 bp, Artificial sequence
  Synthetic Oligonucleotide
gattgagaaatgtaaacggt

SEQ ID NO: 2303 - DNA, 20 bp, Artificial sequence
  Synthetic Oligonucleotide
tgattgagaaatgtaaacgg

SEQ ID NO: 2304 - DNA, 20 bp, Artificial sequence
  Synthetic Oligonucleotide
ttgattgagaaatgtaaacg

SEQ ID NO: 2305 - DNA, 20 bp, Artificial sequence
  Synthetic Oligonucleotide
tttgattgagaaatgtaaac

SEQ ID NO: 2306 - DNA, 20 bp, Artificial sequence
  Synthetic Oligonucleotide
ttttgattgagaaatgtaaa

SEQ ID NO: 2307 - DNA, 20 bp, Artificial sequence
  Synthetic Oligonucleotide
attttgattgagaaatgtaa

SEQ ID NO: 2308 - DNA, 20 bp, Artificial sequence
  Synthetic Oligonucleotide
aattttgattgagaaatgta

SEQ ID NO: 2309 - DNA, 20 bp, Artificial sequence
  Synthetic Oligonucleotide
gaattttgattgagaaatgt

SEQ ID NO: 2310 - DNA, 20 bp, Artificial sequence
  Synthetic Oligonucleotide
agaattttgattgagaaatg

SEQ ID NO: 2311 - DNA, 20 bp, Artificial sequence
  Synthetic Oligonucleotide
aagaattttgattgagaaat

SEQ ID NO: 2312 - DNA, 20 bp, Artificial sequence
  Synthetic Oligonucleotide
ataagaattttgattgagaa

SEQ ID NO: 2313 - DNA, 20 bp, Artificial sequence
  Synthetic Oligonucleotide
tataagaattttgattgaga

SEQ ID NO: 2314 - DNA, 20 bp, Artificial sequence
  Synthetic Oligonucleotide
ttataagaattttgattgag

SEQ ID NO: 2315 - DNA, 20 bp, Artificial sequence
  Synthetic Oligonucleotide
attataagaattttgattga

SEQ ID NO: 2316 - DNA, 20 bp, Artificial sequence
  Synthetic Oligonucleotide
tattataagaattttgattg

SEQ ID NO: 2317 - DNA, 20 bp, Artificial sequence
  Synthetic Oligonucleotide
gtattataagaattttgatt

SEQ ID NO: 2318 - DNA, 20 bp, Artificial sequence
  Synthetic Oligonucleotide
agtattataagaattttgat

SEQ ID NO: 2319 - DNA, 20 bp, Artificial sequence
  Synthetic Oligonucleotide
tagtattataagaattttga

SEQ ID NO: 2320 - DNA, 20 bp, Artificial sequence
  Synthetic Oligonucleotide
aaaacaaatagtattataag

SEQ ID NO: 2321 - DNA, 20 bp, Artificial sequence
  Synthetic Oligonucleotide
taaaacaaatagtattataa

SEQ ID NO: 2322 - DNA, 20 bp, Artificial sequence
  Synthetic Oligonucleotide
attcccacatcacaaaattt

SEQ ID NO: 2323 - DNA, 20 bp, Artificial sequence
  Synthetic Oligonucleotide
gattcccacatcacaaaatt

SEQ ID NO: 2324 - DNA, 20 bp, Artificial sequence
  Synthetic Oligonucleotide
tgattcccacatcacaaaat

SEQ ID NO: 2325 - DNA, 20 bp, Artificial sequence
  Synthetic Oligonucleotide
aaattgattcccacatcaca

SEQ ID NO: 2326 - DNA, 20 bp, Artificial sequence
  Synthetic Oligonucleotide
aaaattgattcccacatcac

SEQ ID NO: 2327 - DNA, 20 bp, Artificial sequence
  Synthetic Oligonucleotide
atctaaaattgattcccaca

SEQ ID NO: 2328 - DNA, 20 bp, Artificial sequence
  Synthetic Oligonucleotide
gaccatctaaaattgattcc

SEQ ID NO: 2329 - DNA, 20 bp, Artificial sequence
  Synthetic Oligonucleotide
tgaccatctaaaattgattc

SEQ ID NO: 2330 - DNA, 20 bp, Artificial sequence
  Synthetic Oligonucleotide
gtgaccatctaaaattgatt

SEQ ID NO: 2331 - DNA, 20 bp, Artificial sequence
  Synthetic Oligonucleotide
tgtgaccatctaaaattgat

SEQ ID NO: 2332 - DNA, 20 bp, Artificial sequence
  Synthetic Oligonucleotide
ttgtgaccatctaaaattga

SEQ ID NO: 2333 - DNA, 20 bp, Artificial sequence
  Synthetic Oligonucleotide
attgtgaccatctaaaattg

SEQ ID NO: 2334 - DNA, 20 bp, Artificial sequence
  Synthetic Oligonucleotide
gattgtgaccatctaaaatt

SEQ ID NO: 2335 - DNA, 20 bp, Artificial sequence
  Synthetic Oligonucleotide
agattgtgaccatctaaaat

SEQ ID NO: 2336 - DNA, 20 bp, Artificial sequence
  Synthetic Oligonucleotide
tagattgtgaccatctaaaa

SEQ ID NO: 2337 - DNA, 20 bp, Artificial sequence
  Synthetic Oligonucleotide
ctagattgtgaccatctaaa

SEQ ID NO: 2338 - DNA, 20 bp, Artificial sequence
  Synthetic Oligonucleotide
tctagattgtgaccatctaa

SEQ ID NO: 2339 - DNA, 20 bp, Artificial sequence
  Synthetic Oligonucleotide
atctagattgtgaccatcta

SEQ ID NO: 2340 - DNA, 20 bp, Artificial sequence
  Synthetic Oligonucleotide
aatctagattgtgaccatct

SEQ ID NO: 2341 - DNA, 20 bp, Artificial sequence
  Synthetic Oligonucleotide
taatctagattgtgaccatc

SEQ ID NO: 2342 - DNA, 20 bp, Artificial sequence
  Synthetic Oligonucleotide
ataatctagattgtgaccat

SEQ ID NO: 2343 - DNA, 20 bp, Artificial sequence
  Synthetic Oligonucleotide
tataatctagattgtgacca

SEQ ID NO: 2344 - DNA, 20 bp, Artificial sequence
  Synthetic Oligonucleotide
ttataatctagattgtgacc

SEQ ID NO: 2345 - DNA, 20 bp, Artificial sequence
  Synthetic Oligonucleotide
tgattataatctagattgtg

SEQ ID NO: 2346 - DNA, 20 bp, Artificial sequence
  Synthetic Oligonucleotide
ttgattataatctagattgt

SEQ ID NO: 2347 - DNA, 20 bp, Artificial sequence
  Synthetic Oligonucleotide
attgattataatctagattg

SEQ ID NO: 2348 - DNA, 20 bp, Artificial sequence
  Synthetic Oligonucleotide
tattgattataatctagatt

SEQ ID NO: 2349 - DNA, 20 bp, Artificial sequence
  Synthetic Oligonucleotide
ctattgattataatctagat

SEQ ID NO: 2350 - DNA, 20 bp, Artificial sequence
  Synthetic Oligonucleotide
cctattgattataatctaga

SEQ ID NO: 2351 - DNA, 20 bp, Artificial sequence
  Synthetic Oligonucleotide
acctattgattataatctag

SEQ ID NO: 2352 - DNA, 20 bp, Artificial sequence
  Synthetic Oligonucleotide
cacctattgattataatcta

SEQ ID NO: 2353 - DNA, 20 bp, Artificial sequence
  Synthetic Oligonucleotide
tcacctattgattataatct

SEQ ID NO: 2354 - DNA, 20 bp, Artificial sequence
  Synthetic Oligonucleotide
ttcacctattgattataatc

SEQ ID NO: 2355 - DNA, 20 bp, Artificial sequence
  Synthetic Oligonucleotide
gttcacctattgattataat

SEQ ID NO: 2356 - DNA, 20 bp, Artificial sequence
  Synthetic Oligonucleotide
agttcacctattgattataa

SEQ ID NO: 2357 - DNA, 20 bp, Artificial sequence
  Synthetic Oligonucleotide
aagttcacctattgattata

SEQ ID NO: 2358 - DNA, 20 bp, Artificial sequence
  Synthetic Oligonucleotide
ataagttcacctattgatta

SEQ ID NO: 2359 - DNA, 20 bp, Artificial sequence
  Synthetic Oligonucleotide
aataagttcacctattgatt

SEQ ID NO: 2360 - DNA, 20 bp, Artificial sequence
  Synthetic Oligonucleotide
taataagttcacctattgat

SEQ ID NO: 2361 - DNA, 20 bp, Artificial sequence
  Synthetic Oligonucleotide
ttaataagttcacctattga

SEQ ID NO: 2362 - DNA, 20 bp, Artificial sequence
  Synthetic Oligonucleotide
tgagtattctcgacttacct

SEQ ID NO: 2363 - DNA, 20 bp, Artificial sequence
  Synthetic Oligonucleotide
aagtgagtattctcgactta

SEQ ID NO: 2364 - DNA, 20 bp, Artificial sequence
  Synthetic Oligonucleotide
attaagtgagtattctcgac

SEQ ID NO: 2365 - DNA, 20 bp, Artificial sequence
  Synthetic Oligonucleotide
ccagaattaagtgagtattc

SEQ ID NO: 2366 - DNA, 20 bp, Artificial sequence
  Synthetic Oligonucleotide
tgggttgctttcttaccaga

SEQ ID NO: 2367 - DNA, 20 bp, Artificial sequence
  Synthetic Oligonucleotide
aaatgggttgctttcttacc

SEQ ID NO: 2368 - DNA, 20 bp, Artificial sequence
  Synthetic Oligonucleotide
tacaaatgggttgctttctt

SEQ ID NO: 2369 - DNA, 20 bp, Artificial sequence
  Synthetic Oligonucleotide
aagtacaaatgggttgcttt

SEQ ID NO: 2370 - DNA, 20 bp, Artificial sequence
  Synthetic Oligonucleotide
gtaaatacaagtacaaatgg

SEQ ID NO: 2371 - DNA, 20 bp, Artificial sequence
  Synthetic Oligonucleotide
ttgctggtaaatacaagtac

SEQ ID NO: 2372 - DNA, 20 bp, Artificial sequence
  Synthetic Oligonucleotide
taaggattgctggtaaatac

SEQ ID NO: 2373 - DNA, 20 bp, Artificial sequence
  Synthetic Oligonucleotide
ttttaaggattgctggtaaa

SEQ ID NO: 2374 - DNA, 20 bp, Artificial sequence
  Synthetic Oligonucleotide
gaagcttcattttaaggatt

SEQ ID NO: 2375 - DNA, 20 bp, Artificial sequence
  Synthetic Oligonucleotide
taggaagcttcattttaagg

SEQ ID NO: 2376 - DNA, 20 bp, Artificial sequence
  Synthetic Oligonucleotide
tagtaggaagcttcatttta

SEQ ID NO: 2377 - DNA, 20 bp, Artificial sequence
  Synthetic Oligonucleotide
ttgagttagtaggaagcttc

SEQ ID NO: 2378 - DNA, 20 bp, Artificial sequence
  Synthetic Oligonucleotide
attgctattgagttagtagg

SEQ ID NO: 2379 - DNA, 20 bp, Artificial sequence
  Synthetic Oligonucleotide
cttattgctattgagttagt

SEQ ID NO: 2380 - DNA, 20 bp, Artificial sequence
  Synthetic Oligonucleotide
attgtcttattgctattgag

SEQ ID NO: 2381 - DNA, 20 bp, Artificial sequence
  Synthetic Oligonucleotide
actattgtcttattgctatt

SEQ ID NO: 2382 - DNA, 20 bp, Artificial sequence
  Synthetic Oligonucleotide
ttcactattgtcttattgct

SEQ ID NO: 2383 - DNA, 20 bp, Artificial sequence
  Synthetic Oligonucleotide
acattcactattgtcttatt

SEQ ID NO: 2384 - DNA, 20 bp, Artificial sequence
  Synthetic Oligonucleotide
taaacattcactattgtctt

SEQ ID NO: 2385 - DNA, 20 bp, Artificial sequence
  Synthetic Oligonucleotide
cattaaacattcactattgt

SEQ ID NO: 2386 - DNA, 20 bp, Artificial sequence
  Synthetic Oligonucleotide
gttttcattaaacattcact

SEQ ID NO: 2387 - DNA, 20 bp, Artificial sequence
  Synthetic Oligonucleotide
aaatactgttttcattaaac

SEQ ID NO: 2388 - DNA, 20 bp, Artificial sequence
  Synthetic Oligonucleotide
aaagtatttataaaatactg

SEQ ID NO: 2389 - DNA, 20 bp, Artificial sequence
  Synthetic Oligonucleotide
cctttttattaaagtattta

SEQ ID NO: 2390 - DNA, 20 bp, Artificial sequence
  Synthetic Oligonucleotide
caatcctttttattaaagta

SEQ ID NO: 2391 - DNA, 20 bp, Artificial sequence
  Synthetic Oligonucleotide
cttcatcacaatccttttta

SEQ ID NO: 2392 - DNA, 20 bp, Artificial sequence
  Synthetic Oligonucleotide
gttcttcatcacaatccttt

SEQ ID NO: 2393 - DNA, 20 bp, Artificial sequence
  Synthetic Oligonucleotide
attgttcttcatcacaatcc

SEQ ID NO: 2394 - DNA, 20 bp, Artificial sequence
  Synthetic Oligonucleotide
tagattgttcttcatcacaa

SEQ ID NO: 2395 - DNA, 20 bp, Artificial sequence
  Synthetic Oligonucleotide
aaatagattgttcttcatca

SEQ ID NO: 2396 - DNA, 20 bp, Artificial sequence
  Synthetic Oligonucleotide
aacaaatataaatagattgt

SEQ ID NO: 2397 - DNA, 20 bp, Artificial sequence
  Synthetic Oligonucleotide
caaataacaaatataaatag

SEQ ID NO: 2398 - DNA, 20 bp, Artificial sequence
  Synthetic Oligonucleotide
tggaattaaaaacaaataac

SEQ ID NO: 2399 - DNA, 20 bp, Artificial sequence
  Synthetic Oligonucleotide
ttattggaattaaaaacaaa

SEQ ID NO: 2400 - DNA, 20 bp, Artificial sequence
  Synthetic Oligonucleotide
tttttattggaattaaaaac

SEQ ID NO: 2401 - DNA, 20 bp, Artificial sequence
  Synthetic Oligonucleotide
taataacttttttctgtaat

SEQ ID NO: 2402 - DNA, 20 bp, Artificial sequence
  Synthetic Oligonucleotide
gttcttaataacttttttct

SEQ ID NO: 2403 - DNA, 20 bp, Artificial sequence
  Synthetic Oligonucleotide
aaaagcatggttcttaataa

SEQ ID NO: 2404 - DNA, 20 bp, Artificial sequence
  Synthetic Oligonucleotide
aaatttaaaagcatggttct

SEQ ID NO: 2405 - DNA, 20 bp, Artificial sequence
  Synthetic Oligonucleotide
aggaataaatttaaaaaatc

SEQ ID NO: 2406 - DNA, 20 bp, Artificial sequence
  Synthetic Oligonucleotide
agacaggaataaatttaaaa

SEQ ID NO: 2407 - DNA, 20 bp, Artificial sequence
  Synthetic Oligonucleotide
aaaagacaggaataaattta

SEQ ID NO: 2408 - DNA, 20 bp, Artificial sequence
  Synthetic Oligonucleotide
ctttctttgtagaaaaagac

SEQ ID NO: 2409 - DNA, 20 bp, Artificial sequence
  Synthetic Oligonucleotide
atgctttctttgtagaaaaa

SEQ ID NO: 2410 - DNA, 20 bp, Artificial sequence
  Synthetic Oligonucleotide
tttgcttaatgtatgctttc

SEQ ID NO: 2411 - DNA, 20 bp, Artificial sequence
  Synthetic Oligonucleotide
gtatttgcttaatgtatgct

SEQ ID NO: 2412 - DNA, 20 bp, Artificial sequence
  Synthetic Oligonucleotide
ttggtatttgcttaatgtat

SEQ ID NO: 2413 - DNA, 20 bp, Artificial sequence
  Synthetic Oligonucleotide
cctttggtatttgcttaatg

SEQ ID NO: 2414 - DNA, 20 bp, Artificial sequence
  Synthetic Oligonucleotide
tggcctttggtatttgctta

SEQ ID NO: 2415 - DNA, 20 bp, Artificial sequence
  Synthetic Oligonucleotide
taaacctggcctttggtatt

SEQ ID NO: 2416 - DNA, 20 bp, Artificial sequence
  Synthetic Oligonucleotide
atgtaaacctggcctttggt

SEQ ID NO: 2417 - DNA, 20 bp, Artificial sequence
  Synthetic Oligonucleotide
caaatgtaaacctggccttt

SEQ ID NO: 2418 - DNA, 20 bp, Artificial sequence
  Synthetic Oligonucleotide
cttcaaatgtaaacctggcc

SEQ ID NO: 2419 - DNA, 20 bp, Artificial sequence
  Synthetic Oligonucleotide
tttcttcaaatgtaaacctg

SEQ ID NO: 2420 - DNA, 20 bp, Artificial sequence
  Synthetic Oligonucleotide
tgtcactttcttcaaatgta

SEQ ID NO: 2421 - DNA, 20 bp, Artificial sequence
  Synthetic Oligonucleotide
taatgtcactttcttcaaat

SEQ ID NO: 2422 - DNA, 20 bp, Artificial sequence
  Synthetic Oligonucleotide
aataataatgtcactttctt

SEQ ID NO: 2423 - DNA, 20 bp, Artificial sequence
  Synthetic Oligonucleotide
gagtaataataatgtcactt

SEQ ID NO: 2424 - DNA, 20 bp, Artificial sequence
  Synthetic Oligonucleotide
gacttgagtaataataatgt

SEQ ID NO: 2425 - DNA, 20 bp, Artificial sequence
  Synthetic Oligonucleotide
cctagagacttgagtaataa

SEQ ID NO: 2426 - DNA, 20 bp, Artificial sequence
  Synthetic Oligonucleotide
attcctagagacttgagtaa

SEQ ID NO: 2427 - DNA, 20 bp, Artificial sequence
  Synthetic Oligonucleotide
aagtattcctagagacttga

SEQ ID NO: 2428 - DNA, 20 bp, Artificial sequence
  Synthetic Oligonucleotide
tgtgttaagtattcctagag

SEQ ID NO: 2429 - DNA, 20 bp, Artificial sequence
  Synthetic Oligonucleotide
agagatgtgttaagtattcc

SEQ ID NO: 2430 - DNA, 20 bp, Artificial sequence
  Synthetic Oligonucleotide
gtcaagagatgtgttaagta

SEQ ID NO: 2431 - DNA, 20 bp, Artificial sequence
  Synthetic Oligonucleotide
acagtcaagagatgtgttaa

SEQ ID NO: 2432 - DNA, 20 bp, Artificial sequence
  Synthetic Oligonucleotide
tatacagtcaagagatgtgt

SEQ ID NO: 2433 - DNA, 20 bp, Artificial sequence
  Synthetic Oligonucleotide
ccatatacagtcaagagatg

SEQ ID NO: 2434 - DNA, 20 bp, Artificial sequence
  Synthetic Oligonucleotide
gtaagttgaactaactactg

SEQ ID NO: 2435 - DNA, 20 bp, Artificial sequence
  Synthetic Oligonucleotide
tgagtaagttgaactaacta

SEQ ID NO: 2436 - DNA, 20 bp, Artificial sequence
  Synthetic Oligonucleotide
taatgagtaagttgaactaa

SEQ ID NO: 2437 - DNA, 20 bp, Artificial sequence
  Synthetic Oligonucleotide
aggttaatcttcctaatacg

SEQ ID NO: 2438 - DNA, 20 bp, Artificial sequence
  Synthetic Oligonucleotide
ataaccaggttaatcttcct

SEQ ID NO: 2439 - DNA, 20 bp, Artificial sequence
  Synthetic Oligonucleotide
atgataaccaggttaatctt

SEQ ID NO: 2440 - DNA, 20 bp, Artificial sequence
  Synthetic Oligonucleotide
aacaatgataaccaggttaa

SEQ ID NO: 2441 - DNA, 20 bp, Artificial sequence
  Synthetic Oligonucleotide
taaaacaatgataaccaggt

SEQ ID NO: 2442 - DNA, 20 bp, Artificial sequence
  Synthetic Oligonucleotide
gtataaaacaatgataacca

SEQ ID NO: 2443 - DNA, 20 bp, Artificial sequence
  Synthetic Oligonucleotide
cgaatactcatatatatttc

SEQ ID NO: 2444 - DNA, 20 bp, Artificial sequence
  Synthetic Oligonucleotide
atacgaatactcatatatat

SEQ ID NO: 2445 - DNA, 20 bp, Artificial sequence
  Synthetic Oligonucleotide
tttatacgaatactcatata

SEQ ID NO: 2446 - DNA, 20 bp, Artificial sequence
  Synthetic Oligonucleotide
atatttatacgaatactcat

SEQ ID NO: 2447 - DNA, 20 bp, Artificial sequence
  Synthetic Oligonucleotide
gtattatatttatacgaata

SEQ ID NO: 2448 - DNA, 20 bp, Artificial sequence
  Synthetic Oligonucleotide
aaaagtattatatttatacg

SEQ ID NO: 2449 - DNA, 20 bp, Artificial sequence
  Synthetic Oligonucleotide
ggtaaaagtattatatttat

SEQ ID NO: 2450 - DNA, 20 bp, Artificial sequence
  Synthetic Oligonucleotide
acaaggtaaaagtattatat

SEQ ID NO: 2451 - DNA, 20 bp, Artificial sequence
  Synthetic Oligonucleotide
taaacaaggtaaaagtatta

SEQ ID NO: 2452 - DNA, 20 bp, Artificial sequence
  Synthetic Oligonucleotide
acataaacaaggtaaaagta

SEQ ID NO: 2453 - DNA, 20 bp, Artificial sequence
  Synthetic Oligonucleotide
ttgagtaaatacataaacaa

SEQ ID NO: 2454 - DNA, 20 bp, Artificial sequence
  Synthetic Oligonucleotide
gagaatattgagtaaataca

SEQ ID NO: 2455 - DNA, 20 bp, Artificial sequence
  Synthetic Oligonucleotide
aaggagaatattgagtaaat

SEQ ID NO: 2456 - DNA, 20 bp, Artificial sequence
  Synthetic Oligonucleotide
gaaaaggagaatattgagta

SEQ ID NO: 2457 - DNA, 20 bp, Artificial sequence
  Synthetic Oligonucleotide
gaggaaaaggagaatattga

SEQ ID NO: 2458 - DNA, 20 bp, Artificial sequence
  Synthetic Oligonucleotide
ttagaggaaaaggagaatat

SEQ ID NO: 2459 - DNA, 20 bp, Artificial sequence
  Synthetic Oligonucleotide
attattttagaggaaaagga

SEQ ID NO: 2460 - DNA, 20 bp, Artificial sequence
  Synthetic Oligonucleotide
cagattattttagaggaaaa

SEQ ID NO: 2461 - DNA, 20 bp, Artificial sequence
  Synthetic Oligonucleotide
cttcagattattttagagga

SEQ ID NO: 2462 - DNA, 20 bp, Artificial sequence
  Synthetic Oligonucleotide
tagtcacttcagattatttt

SEQ ID NO: 2463 - DNA, 20 bp, Artificial sequence
  Synthetic Oligonucleotide
taatagtcacttcagattat

SEQ ID NO: 2464 - DNA, 20 bp, Artificial sequence
  Synthetic Oligonucleotide
tgataatagtcacttcagat

SEQ ID NO: 2465 - DNA, 20 bp, Artificial sequence
  Synthetic Oligonucleotide
tattgataatagtcacttca

SEQ ID NO: 2466 - DNA, 20 bp, Artificial sequence
  Synthetic Oligonucleotide
acttattgataatagtcact

SEQ ID NO: 2467 - DNA, 20 bp, Artificial sequence
  Synthetic Oligonucleotide
taaacttattgataatagtc

SEQ ID NO: 2468 - DNA, 20 bp, Artificial sequence
  Synthetic Oligonucleotide
tagtaaacttattgataata

SEQ ID NO: 2469 - DNA, 20 bp, Artificial sequence
  Synthetic Oligonucleotide
gcatagtaaacttattgata

SEQ ID NO: 2470 - DNA, 20 bp, Artificial sequence
  Synthetic Oligonucleotide
ttggcatagtaaacttattg

SEQ ID NO: 2471 - DNA, 20 bp, Artificial sequence
  Synthetic Oligonucleotide
attttggcatagtaaactta

SEQ ID NO: 2472 - DNA, 20 bp, Artificial sequence
  Synthetic Oligonucleotide
tgaattttggcatagtaaac

SEQ ID NO: 2473 - DNA, 20 bp, Artificial sequence
  Synthetic Oligonucleotide
ttaatgaattttggcatagt

SEQ ID NO: 2474 - DNA, 20 bp, Artificial sequence
  Synthetic Oligonucleotide
caattaatgaattttggcat

SEQ ID NO: 2475 - DNA, 20 bp, Artificial sequence
  Synthetic Oligonucleotide
aaaggcaattaatgaatttt

SEQ ID NO: 2476 - DNA, 20 bp, Artificial sequence
  Synthetic Oligonucleotide
gtgaaaggcaattaatgaat

SEQ ID NO: 2477 - DNA, 20 bp, Artificial sequence
  Synthetic Oligonucleotide
ttaagtgaaaggcaattaat

SEQ ID NO: 2478 - DNA, 20 bp, Artificial sequence
  Synthetic Oligonucleotide
aagttaagtgaaaggcaatt

SEQ ID NO: 2479 - DNA, 20 bp, Artificial sequence
  Synthetic Oligonucleotide
ccaaaagttaagtgaaaggc

SEQ ID NO: 2480 - DNA, 20 bp, Artificial sequence
  Synthetic Oligonucleotide
gtcccaaaagttaagtgaaa

SEQ ID NO: 2481 - DNA, 20 bp, Artificial sequence
  Synthetic Oligonucleotide
atggtcccaaaagttaagtg

SEQ ID NO: 2482 - DNA, 20 bp, Artificial sequence
  Synthetic Oligonucleotide
attatggtcccaaaagttaa

SEQ ID NO: 2483 - DNA, 20 bp, Artificial sequence
  Synthetic Oligonucleotide
tttattatggtcccaaaagt

SEQ ID NO: 2484 - DNA, 20 bp, Artificial sequence
  Synthetic Oligonucleotide
ttattatttattatggtccc

SEQ ID NO: 2485 - DNA, 20 bp, Artificial sequence
  Synthetic Oligonucleotide
atggcaatacattttattat

SEQ ID NO: 2486 - DNA, 20 bp, Artificial sequence
  Synthetic Oligonucleotide
gttatggcaatacattttat

SEQ ID NO: 2487 - DNA, 20 bp, Artificial sequence
  Synthetic Oligonucleotide
taatgttatggcaatacatt

SEQ ID NO: 2488 - DNA, 20 bp, Artificial sequence
  Synthetic Oligonucleotide
tattaatgttatggcaatac

SEQ ID NO: 2489 - DNA, 20 bp, Artificial sequence
  Synthetic Oligonucleotide
gtttattaatgttatggcaa

SEQ ID NO: 2490 - DNA, 20 bp, Artificial sequence
  Synthetic Oligonucleotide
gtagtttattaatgttatgg

SEQ ID NO: 2491 - DNA, 20 bp, Artificial sequence
  Synthetic Oligonucleotide
aaggtagtttattaatgtta

SEQ ID NO: 2492 - DNA, 20 bp, Artificial sequence
  Synthetic Oligonucleotide
tgtaaggtagtttattaatg

SEQ ID NO: 2493 - DNA, 20 bp, Artificial sequence
  Synthetic Oligonucleotide
ttttgtaaggtagtttatta

SEQ ID NO: 2494 - DNA, 20 bp, Artificial sequence
  Synthetic Oligonucleotide
tggttttgtaaggtagttta

SEQ ID NO: 2495 - DNA, 20 bp, Artificial sequence
  Synthetic Oligonucleotide
tggtggttttgtaaggtagt

SEQ ID NO: 2496 - DNA, 20 bp, Artificial sequence
  Synthetic Oligonucleotide
aattggtggttttgtaaggt

SEQ ID NO: 2497 - DNA, 20 bp, Artificial sequence
  Synthetic Oligonucleotide
tttaattggtggttttgtaa

SEQ ID NO: 2498 - DNA, 20 bp, Artificial sequence
  Synthetic Oligonucleotide
ttgattttaattggtggttt

SEQ ID NO: 2499 - DNA, 20 bp, Artificial sequence
  Synthetic Oligonucleotide
tgtttgattttaattggtgg

SEQ ID NO: 2500 - DNA, 20 bp, Artificial sequence
  Synthetic Oligonucleotide
atgtaaataacacttttttg

SEQ ID NO: 2501 - DNA, 20 bp, Artificial sequence
  Synthetic Oligonucleotide
cagatgtaaataacactttt

SEQ ID NO: 2502 - DNA, 20 bp, Artificial sequence
  Synthetic Oligonucleotide
tgacagatgtaaataacact

SEQ ID NO: 2503 - DNA, 20 bp, Artificial sequence
  Synthetic Oligonucleotide
atgttgacagatgtaaataa

SEQ ID NO: 2504 - DNA, 20 bp, Artificial sequence
  Synthetic Oligonucleotide
tttatgttgacagatgtaaa

SEQ ID NO: 2505 - DNA, 20 bp, Artificial sequence
  Synthetic Oligonucleotide
agatttatgttgacagatgt

SEQ ID NO: 2506 - DNA, 20 bp, Artificial sequence
  Synthetic Oligonucleotide
agtagatttatgttgacaga

SEQ ID NO: 2507 - DNA, 20 bp, Artificial sequence
  Synthetic Oligonucleotide
tttagtagatttatgttgac

SEQ ID NO: 2508 - DNA, 20 bp, Artificial sequence
  Synthetic Oligonucleotide
atttttagtagatttatgtt

SEQ ID NO: 2509 - DNA, 20 bp, Artificial sequence
  Synthetic Oligonucleotide
catgtatttttagtagattt

SEQ ID NO: 2510 - DNA, 20 bp, Artificial sequence
  Synthetic Oligonucleotide
gaaatcatgtatttttagta

SEQ ID NO: 2511 - DNA, 20 bp, Artificial sequence
  Synthetic Oligonucleotide
attgtatttgatggatatct

SEQ ID NO: 2512 - DNA, 20 bp, Artificial sequence
  Synthetic Oligonucleotide
gatacattgtatttgatgga

SEQ ID NO: 2513 - DNA, 20 bp, Artificial sequence
  Synthetic Oligonucleotide
taggttgatacattgtattt

SEQ ID NO: 2514 - DNA, 20 bp, Artificial sequence
  Synthetic Oligonucleotide
cagtttaggttgatacattg

SEQ ID NO: 2515 - DNA, 20 bp, Artificial sequence
  Synthetic Oligonucleotide
gcatccagtttaggttgata

SEQ ID NO: 2516 - DNA, 20 bp, Artificial sequence
  Synthetic Oligonucleotide
ccccagcatccagtttaggt

SEQ ID NO: 2517 - DNA, 20 bp, Artificial sequence
  Synthetic Oligonucleotide
aagaaccccagcatccagtt

SEQ ID NO: 2518 - DNA, 20 bp, Artificial sequence
  Synthetic Oligonucleotide
gtgtaaaaagaaccccagca

SEQ ID NO: 2519 - DNA, 20 bp, Artificial sequence
  Synthetic Oligonucleotide
atagggtgtaaaaagaaccc

SEQ ID NO: 2520 - DNA, 20 bp, Artificial sequence
  Synthetic Oligonucleotide
cttttatagggtgtaaaaag

SEQ ID NO: 2521 - DNA, 20 bp, Artificial sequence
  Synthetic Oligonucleotide
tatgtcttttatagggtgta

SEQ ID NO: 2522 - DNA, 20 bp, Artificial sequence
  Synthetic Oligonucleotide
ttaggtatgtcttttatagg

SEQ ID NO: 2523 - DNA, 20 bp, Artificial sequence
  Synthetic Oligonucleotide
ttgtcttaggtatgtctttt

SEQ ID NO: 2524 - DNA, 20 bp, Artificial sequence
  Synthetic Oligonucleotide
ctctgattgtcttaggtatg

SEQ ID NO: 2525 - DNA, 20 bp, Artificial sequence
  Synthetic Oligonucleotide
tatttctctgattgtcttag

SEQ ID NO: 2526 - DNA, 20 bp, Artificial sequence
  Synthetic Oligonucleotide
tcaagtccatatttgtattt

SEQ ID NO: 2527 - DNA, 20 bp, Artificial sequence
  Synthetic Oligonucleotide
aataatcaagtccatatttg

SEQ ID NO: 2528 - DNA, 20 bp, Artificial sequence
  Synthetic Oligonucleotide
ttatctaataatcaagtcca

SEQ ID NO: 2529 - DNA, 20 bp, Artificial sequence
  Synthetic Oligonucleotide
ctatattatctaataatcaa

SEQ ID NO: 2530 - DNA, 20 bp, Artificial sequence
  Synthetic Oligonucleotide
taaaccttctatattatcta

SEQ ID NO: 2531 - DNA, 20 bp, Artificial sequence
  Synthetic Oligonucleotide
aattaataaaccttctatat

SEQ ID NO: 2532 - DNA, 20 bp, Artificial sequence
  Synthetic Oligonucleotide
taagtacaggttggacactg

SEQ ID NO: 2533 - DNA, 20 bp, Artificial sequence
  Synthetic Oligonucleotide
gttattaagtacaggttgga

SEQ ID NO: 2534 - DNA, 20 bp, Artificial sequence
  Synthetic Oligonucleotide
tgtgagttattaagtacagg

SEQ ID NO: 2535 - DNA, 20 bp, Artificial sequence
  Synthetic Oligonucleotide
aaatctgtgagttattaagt

SEQ ID NO: 2536 - DNA, 20 bp, Artificial sequence
  Synthetic Oligonucleotide
gttttaaaaatctgtgagtt

SEQ ID NO: 2537 - DNA, 20 bp, Artificial sequence
  Synthetic Oligonucleotide
caaaattctcctgaaaagaa

SEQ ID NO: 2538 - DNA, 20 bp, Artificial sequence
  Synthetic Oligonucleotide
cccaaccaaaattctcctga

SEQ ID NO: 2539 - DNA, 20 bp, Artificial sequence
  Synthetic Oligonucleotide
acctgaataaccctctggac

SEQ ID NO: 2540 - DNA, 20 bp, Artificial sequence
  Synthetic Oligonucleotide
aagatacctgaataaccctc

SEQ ID NO: 2541 - DNA, 20 bp, Artificial sequence
  Synthetic Oligonucleotide
agaaaaagatacctgaataa

SEQ ID NO: 2542 - DNA, 20 bp, Artificial sequence
  Synthetic Oligonucleotide
tggtatcagaaaaagatacc

SEQ ID NO: 2543 - DNA, 20 bp, Artificial sequence
  Synthetic Oligonucleotide
agtattggtatcagaaaaag

SEQ ID NO: 2544 - DNA, 20 bp, Artificial sequence
  Synthetic Oligonucleotide
aataaagtattggtatcaga

SEQ ID NO: 2545 - DNA, 20 bp, Artificial sequence
  Synthetic Oligonucleotide
atgaaaataaagtattggta

SEQ ID NO: 2546 - DNA, 20 bp, Artificial sequence
  Synthetic Oligonucleotide
agatactttgaagatatgaa

SEQ ID NO: 2547 - DNA, 20 bp, Artificial sequence
  Synthetic Oligonucleotide
tgggaagatactttgaagat

SEQ ID NO: 2548 - DNA, 20 bp, Artificial sequence
  Synthetic Oligonucleotide
ctaataatgtgggaagatac

SEQ ID NO: 2549 - DNA, 20 bp, Artificial sequence
  Synthetic Oligonucleotide
cattgcagataatagctaat

SEQ ID NO: 2550 - DNA, 20 bp, Artificial sequence
  Synthetic Oligonucleotide
aagttgtcattgcagataat

SEQ ID NO: 2551 - DNA, 20 bp, Artificial sequence
  Synthetic Oligonucleotide
ttttaaaagttgtcattgca

SEQ ID NO: 2552 - DNA, 20 bp, Artificial sequence
  Synthetic Oligonucleotide
attcggatttttaaaagttg

SEQ ID NO: 2553 - DNA, 20 bp, Artificial sequence
  Synthetic Oligonucleotide
ttatttgggattcggatttt

SEQ ID NO: 2554 - DNA, 20 bp, Artificial sequence
  Synthetic Oligonucleotide
ttatagttaagaggttttcg

SEQ ID NO: 2555 - DNA, 20 bp, Artificial sequence
  Synthetic Oligonucleotide
tttcattatagttaagaggt

SEQ ID NO: 2556 - DNA, 20 bp, Artificial sequence
  Synthetic Oligonucleotide
gaacactttcattatagtta

SEQ ID NO: 2557 - DNA, 20 bp, Artificial sequence
  Synthetic Oligonucleotide
gaactagaatgaacactttc

SEQ ID NO: 2558 - DNA, 20 bp, Artificial sequence
  Synthetic Oligonucleotide
tgattgaactagaatgaaca

SEQ ID NO: 2559 - DNA, 20 bp, Artificial sequence
  Synthetic Oligonucleotide
atacctgattgaactagaat

SEQ ID NO: 2560 - DNA, 20 bp, Artificial sequence
  Synthetic Oligonucleotide
gtaaaatacctgattgaact

SEQ ID NO: 2561 - DNA, 20 bp, Artificial sequence
  Synthetic Oligonucleotide
tagaggtaaaatacctgatt

SEQ ID NO: 2562 - DNA, 20 bp, Artificial sequence
  Synthetic Oligonucleotide
aagattagaggtaaaatacc

SEQ ID NO: 2563 - DNA, 20 bp, Artificial sequence
  Synthetic Oligonucleotide
tgaggaagattagaggtaaa

SEQ ID NO: 2564 - DNA, 20 bp, Artificial sequence
  Synthetic Oligonucleotide
gaaaatctgaggaagattag

SEQ ID NO: 2565 - DNA, 20 bp, Artificial sequence
  Synthetic Oligonucleotide
aaatagaaaatctgaggaag

SEQ ID NO: 2566 - DNA, 20 bp, Artificial sequence
  Synthetic Oligonucleotide
atctatacactaccaaaaaa

SEQ ID NO: 2567 - DNA, 20 bp, Artificial sequence
  Synthetic Oligonucleotide
aaataatctatacactacca

SEQ ID NO: 2568 - DNA, 20 bp, Artificial sequence
  Synthetic Oligonucleotide
aaataatctgtataaataat

SEQ ID NO: 2569 - DNA, 20 bp, Artificial sequence
  Synthetic Oligonucleotide
cccaattttaaataatctgt

SEQ ID NO: 2570 - DNA, 20 bp, Artificial sequence
  Synthetic Oligonucleotide
taagtcccaattttaaataa

SEQ ID NO: 2571 - DNA, 20 bp, Artificial sequence
  Synthetic Oligonucleotide
tctgtataagtcccaatttt

SEQ ID NO: 2572 - DNA, 20 bp, Artificial sequence
  Synthetic Oligonucleotide
aataatctgtataagtccca

SEQ ID NO: 2573 - DNA, 20 bp, Artificial sequence
  Synthetic Oligonucleotide
agttttaaataatctgtata

SEQ ID NO: 2574 - DNA, 20 bp, Artificial sequence
  Synthetic Oligonucleotide
atcccagttttaaataatct

SEQ ID NO: 2575 - DNA, 20 bp, Artificial sequence
  Synthetic Oligonucleotide
catgtatcccagttttaaat

SEQ ID NO: 2576 - DNA, 20 bp, Artificial sequence
  Synthetic Oligonucleotide
tagatgcatgtatcccagtt

SEQ ID NO: 2577 - DNA, 20 bp, Artificial sequence
  Synthetic Oligonucleotide
tgttttagatgcatgtatcc

SEQ ID NO: 2578 - DNA, 20 bp, Artificial sequence
  Synthetic Oligonucleotide
tacagtgttttagatgcatg

SEQ ID NO: 2579 - DNA, 20 bp, Artificial sequence
  Synthetic Oligonucleotide
aatattacagtgttttagat

SEQ ID NO: 2580 - DNA, 20 bp, Artificial sequence
  Synthetic Oligonucleotide
cttataaatattacagtgtt

SEQ ID NO: 2581 - DNA, 20 bp, Artificial sequence
  Synthetic Oligonucleotide
cttcctttcttataaatatt

SEQ ID NO: 2582 - DNA, 20 bp, Artificial sequence
  Synthetic Oligonucleotide
tttatcttcctttcttataa

SEQ ID NO: 2583 - DNA, 20 bp, Artificial sequence
  Synthetic Oligonucleotide
ttccccgtaagtttatcttc

SEQ ID NO: 2584 - DNA, 20 bp, Artificial sequence
  Synthetic Oligonucleotide
tgtatttccccgtaagttta

SEQ ID NO: 2585 - DNA, 20 bp, Artificial sequence
  Synthetic Oligonucleotide
gttactgtatttccccgtaa

SEQ ID NO: 2586 - DNA, 20 bp, Artificial sequence
  Synthetic Oligonucleotide
tgttttcttctggaagcaga

SEQ ID NO: 2587 - DNA, 20 bp, Artificial sequence
  Synthetic Oligonucleotide
cagacctagacttcttaact

SEQ ID NO: 2588 - DNA, 20 bp, Artificial sequence
  Synthetic Oligonucleotide
agcagacctagacttcttaa

SEQ ID NO: 2589 - DNA, 20 bp, Artificial sequence
  Synthetic Oligonucleotide
ttttcttctggaagcagacc

SEQ ID NO: 2590 - DNA, 20 bp, Artificial sequence
  Synthetic Oligonucleotide
aaacatatatacatgcttgt

SEQ ID NO: 2591 - DNA, 20 bp, Artificial sequence
  Synthetic Oligonucleotide
ttaaacatatatacatgctt

SEQ ID NO: 2592 - DNA, 20 bp, Artificial sequence
  Synthetic Oligonucleotide
gtttattgaattttaaacat

SEQ ID NO: 2593 - DNA, 20 bp, Artificial sequence
  Synthetic Oligonucleotide
ttgtttattgaattttaaac

SEQ ID NO: 2594 - DNA, 20 bp, Artificial sequence
  Synthetic Oligonucleotide
ctttgtttattgaattttaa

SEQ ID NO: 2595 - DNA, 20 bp, Artificial sequence
  Synthetic Oligonucleotide
gtctttgtttattgaatttt

SEQ ID NO: 2596 - DNA, 20 bp, Artificial sequence
  Synthetic Oligonucleotide
gggtctttgtttattgaatt

SEQ ID NO: 2597 - DNA, 20 bp, Artificial sequence
  Synthetic Oligonucleotide
ctgggtctttgtttattgaa

SEQ ID NO: 2598 - DNA, 20 bp, Artificial sequence
  Synthetic Oligonucleotide
gactgggtctttgtttattg

SEQ ID NO: 2599 - DNA, 20 bp, Artificial sequence
  Synthetic Oligonucleotide
tttctataatttagggactg

SEQ ID NO: 2600 - DNA, 20 bp, Artificial sequence
  Synthetic Oligonucleotide
aatttctataatttagggac

SEQ ID NO: 2601 - DNA, 20 bp, Artificial sequence
  Synthetic Oligonucleotide
taaatttctataatttaggg

SEQ ID NO: 2602 - DNA, 20 bp, Artificial sequence
  Synthetic Oligonucleotide
caagaataatttaaatttct

SEQ ID NO: 2603 - DNA, 20 bp, Artificial sequence
  Synthetic Oligonucleotide
gataaacatgcaagaataat

SEQ ID NO: 2604 - DNA, 20 bp, Artificial sequence
  Synthetic Oligonucleotide
tcgataaacatgcaagaata

SEQ ID NO: 2605 - DNA, 20 bp, Artificial sequence
  Synthetic Oligonucleotide
tgtcgataaacatgcaagaa

SEQ ID NO: 2606 - DNA, 20 bp, Artificial sequence
  Synthetic Oligonucleotide
gatgtcgataaacatgcaag

SEQ ID NO: 2607 - DNA, 20 bp, Artificial sequence
  Synthetic Oligonucleotide
gtgatgtcgataaacatgca

SEQ ID NO: 2608 - DNA, 20 bp, Artificial sequence
  Synthetic Oligonucleotide
ttgtgatgtcgataaacatg

SEQ ID NO: 2609 - DNA, 20 bp, Artificial sequence
  Synthetic Oligonucleotide
tgttgtgatgtcgataaaca

SEQ ID NO: 2610 - DNA, 20 bp, Artificial sequence
  Synthetic Oligonucleotide
tctgttgtgatgtcgataaa

SEQ ID NO: 2611 - DNA, 20 bp, Artificial sequence
  Synthetic Oligonucleotide
gatctgttgtgatgtcgata

SEQ ID NO: 2612 - DNA, 20 bp, Artificial sequence
  Synthetic Oligonucleotide
gggatctgttgtgatgtcga

SEQ ID NO: 2613 - DNA, 20 bp, Artificial sequence
  Synthetic Oligonucleotide
tagggatctgttgtgatgtc

SEQ ID NO: 2614 - DNA, 20 bp, Artificial sequence
  Synthetic Oligonucleotide
tttagggatctgttgtgatg

SEQ ID NO: 2615 - DNA, 20 bp, Artificial sequence
  Synthetic Oligonucleotide
gatttagggatctgttgtga

SEQ ID NO: 2616 - DNA, 20 bp, Artificial sequence
  Synthetic Oligonucleotide
atctaatctttagggattta

SEQ ID NO: 2617 - DNA, 20 bp, Artificial sequence
  Synthetic Oligonucleotide
tttgtatctaatctttaggg

SEQ ID NO: 2618 - DNA, 20 bp, Artificial sequence
  Synthetic Oligonucleotide
aatttgtatctaatctttag

SEQ ID NO: 2619 - DNA, 20 bp, Artificial sequence
  Synthetic Oligonucleotide
gtggtaaaaaatttgtatct

SEQ ID NO: 2620 - DNA, 20 bp, Artificial sequence
  Synthetic Oligonucleotide
ctgtggtaaaaaatttgtat

SEQ ID NO: 2621 - DNA, 20 bp, Artificial sequence
  Synthetic Oligonucleotide
tactgtggtaaaaaatttgt

SEQ ID NO: 2622 - DNA, 20 bp, Artificial sequence
  Synthetic Oligonucleotide
gatactgtggtaaaaaattt

SEQ ID NO: 2623 - DNA, 20 bp, Artificial sequence
  Synthetic Oligonucleotide
agtgatactgtggtaaaaaa

SEQ ID NO: 2624 - DNA, 20 bp, Artificial sequence
  Synthetic Oligonucleotide
caagtgatactgtggtaaaa

SEQ ID NO: 2625 - DNA, 20 bp, Artificial sequence
  Synthetic Oligonucleotide
gacaagtgatactgtggtaa

SEQ ID NO: 2626 - DNA, 20 bp, Artificial sequence
  Synthetic Oligonucleotide
ctgacaagtgatactgtggt

SEQ ID NO: 2627 - DNA, 20 bp, Artificial sequence
  Synthetic Oligonucleotide
ttctgacaagtgatactgtg

SEQ ID NO: 2628 - DNA, 20 bp, Artificial sequence
  Synthetic Oligonucleotide
aattctgacaagtgatactg

SEQ ID NO: 2629 - DNA, 20 bp, Artificial sequence
  Synthetic Oligonucleotide
ataaattctgacaagtgata

SEQ ID NO: 2630 - DNA, 20 bp, Artificial sequence
  Synthetic Oligonucleotide
ctggcagttttaaaaaatca

SEQ ID NO: 2631 - DNA, 20 bp, Artificial sequence
  Synthetic Oligonucleotide
ttcttactggcagttttaaa

SEQ ID NO: 2632 - DNA, 20 bp, Artificial sequence
  Synthetic Oligonucleotide
atttcttactggcagtttta

SEQ ID NO: 2633 - DNA, 20 bp, Artificial sequence
  Synthetic Oligonucleotide
aaatttcttactggcagttt

SEQ ID NO: 2634 - DNA, 20 bp, Artificial sequence
  Synthetic Oligonucleotide
tttaaaatttcttactggca

SEQ ID NO: 2635 - DNA, 20 bp, Artificial sequence
  Synthetic Oligonucleotide
ttaatttaaaatttcttact

SEQ ID NO: 2636 - DNA, 20 bp, Artificial sequence
  Synthetic Oligonucleotide
caaatgggtttaatttaaaa

SEQ ID NO: 2637 - DNA, 20 bp, Artificial sequence
  Synthetic Oligonucleotide
aacaaatgggtttaatttaa

SEQ ID NO: 2638 - DNA, 20 bp, Artificial sequence
  Synthetic Oligonucleotide
ttaacaaatgggtttaattt

SEQ ID NO: 2639 - DNA, 20 bp, Artificial sequence
  Synthetic Oligonucleotide
ctttaacaaatgggtttaat

SEQ ID NO: 2640 - DNA, 20 bp, Artificial sequence
  Synthetic Oligonucleotide
tcctttaacaaatgggttta

SEQ ID NO: 2641 - DNA, 20 bp, Artificial sequence
  Synthetic Oligonucleotide
ctatatcctttaacaaatgg

SEQ ID NO: 2642 - DNA, 20 bp, Artificial sequence
  Synthetic Oligonucleotide
gggcactatatcctttaaca

SEQ ID NO: 2643 - DNA, 20 bp, Artificial sequence
  Synthetic Oligonucleotide
ttgggcactatatcctttaa

SEQ ID NO: 2644 - DNA, 20 bp, Artificial sequence
  Synthetic Oligonucleotide
tataacttgggcactatatc

SEQ ID NO: 2645 - DNA, 20 bp, Artificial sequence
  Synthetic Oligonucleotide
catataacttgggcactata

SEQ ID NO: 2646 - DNA, 20 bp, Artificial sequence
  Synthetic Oligonucleotide
tcaccatataacttgggcac

SEQ ID NO: 2647 - DNA, 20 bp, Artificial sequence
  Synthetic Oligonucleotide
taggtcaccatataacttgg

SEQ ID NO: 2648 - DNA, 20 bp, Artificial sequence
  Synthetic Oligonucleotide
ggtaggtcaccatataactt

SEQ ID NO: 2649 - DNA, 20 bp, Artificial sequence
  Synthetic Oligonucleotide
aaggtaggtcaccatataac

SEQ ID NO: 2650 - DNA, 20 bp, Artificial sequence
  Synthetic Oligonucleotide
caaaggtaggtcaccatata

SEQ ID NO: 2651 - DNA, 20 bp, Artificial sequence
  Synthetic Oligonucleotide
gtattgacaaaggtaggtca

SEQ ID NO: 2652 - DNA, 20 bp, Artificial sequence
  Synthetic Oligonucleotide
aagtattgacaaaggtaggt

SEQ ID NO: 2653 - DNA, 20 bp, Artificial sequence
  Synthetic Oligonucleotide
ctaagtattgacaaaggtag

SEQ ID NO: 2654 - DNA, 20 bp, Artificial sequence
  Synthetic Oligonucleotide
tgctaagtattgacaaaggt

SEQ ID NO: 2655 - DNA, 20 bp, Artificial sequence
  Synthetic Oligonucleotide
aatgctaagtattgacaaag

SEQ ID NO: 2656 - DNA, 20 bp, Artificial sequence
  Synthetic Oligonucleotide
cataatgctaagtattgaca

SEQ ID NO: 2657 - DNA, 20 bp, Artificial sequence
  Synthetic Oligonucleotide
tacataatgctaagtattga

SEQ ID NO: 2658 - DNA, 20 bp, Artificial sequence
  Synthetic Oligonucleotide
aatacataatgctaagtatt

SEQ ID NO: 2659 - DNA, 20 bp, Artificial sequence
  Synthetic Oligonucleotide
gaaatacataatgctaagta

SEQ ID NO: 2660 - DNA, 20 bp, Artificial sequence
  Synthetic Oligonucleotide
tttgaaatacataatgctaa

SEQ ID NO: 2661 - DNA, 20 bp, Artificial sequence
  Synthetic Oligonucleotide
ggataatttgaaatacataa

SEQ ID NO: 2662 - DNA, 20 bp, Artificial sequence
  Synthetic Oligonucleotide
ttggataatttgaaatacat

SEQ ID NO: 2663 - DNA, 20 bp, Artificial sequence
  Synthetic Oligonucleotide
tattggataatttgaaatac

SEQ ID NO: 2664 - DNA, 20 bp, Artificial sequence
  Synthetic Oligonucleotide
atccagttaaagcttgtaaa

SEQ ID NO: 2665 - DNA, 20 bp, Artificial sequence
  Synthetic Oligonucleotide
tcatgatccagttaaagctt

SEQ ID NO: 2666 - DNA, 20 bp, Artificial sequence
  Synthetic Oligonucleotide
tttactcatgatccagttaa

SEQ ID NO: 2667 - DNA, 20 bp, Artificial sequence
  Synthetic Oligonucleotide
gataattttactcatgatcc

SEQ ID NO: 2668 - DNA, 20 bp, Artificial sequence
  Synthetic Oligonucleotide
gatgtgataattttactcat

SEQ ID NO: 2669 - DNA, 20 bp, Artificial sequence
  Synthetic Oligonucleotide
atgctgatgtgataatttta

SEQ ID NO: 2670 - DNA, 20 bp, Artificial sequence
  Synthetic Oligonucleotide
cagttatgctgatgtgataa

SEQ ID NO: 2671 - DNA, 20 bp, Artificial sequence
  Synthetic Oligonucleotide
tttaacagttatgctgatgt

SEQ ID NO: 2672 - DNA, 20 bp, Artificial sequence
  Synthetic Oligonucleotide
gcaattttaacagttatgct

SEQ ID NO: 2673 - DNA, 20 bp, Artificial sequence
  Synthetic Oligonucleotide
agagcctgcaattttaacag

SEQ ID NO: 2674 - DNA, 20 bp, Artificial sequence
  Synthetic Oligonucleotide
gcttcagagcctgcaatttt

SEQ ID NO: 2675 - DNA, 20 bp, Artificial sequence
  Synthetic Oligonucleotide
tattagcttcagagcctgca

SEQ ID NO: 2676 - DNA, 20 bp, Artificial sequence
  Synthetic Oligonucleotide
tagtttattagcttcagagc

SEQ ID NO: 2677 - DNA, 20 bp, Artificial sequence
  Synthetic Oligonucleotide
gcaggtagtttattagcttc

SEQ ID NO: 2678 - DNA, 20 bp, Artificial sequence
  Synthetic Oligonucleotide
taaatgcaggtagtttatta

SEQ ID NO: 2679 - DNA, 20 bp, Artificial sequence
  Synthetic Oligonucleotide
atggtttaaatgcaggtagt

SEQ ID NO: 2680 - DNA, 20 bp, Artificial sequence
  Synthetic Oligonucleotide
gagccatggtttaaatgcag

SEQ ID NO: 2681 - DNA, 20 bp, Artificial sequence
  Synthetic Oligonucleotide
ttttagagccatggtttaaa

SEQ ID NO: 2682 - DNA, 20 bp, Artificial sequence
  Synthetic Oligonucleotide
caaagttttagagccatggt

SEQ ID NO: 2683 - DNA, 20 bp, Artificial sequence
  Synthetic Oligonucleotide
tcacacaaagttttagagcc

SEQ ID NO: 2684 - DNA, 20 bp, Artificial sequence
  Synthetic Oligonucleotide
caaggtcacacaaagtttta

SEQ ID NO: 2685 - DNA, 20 bp, Artificial sequence
  Synthetic Oligonucleotide
gggtgaagtaatttattcaa

SEQ ID NO: 2686 - DNA, 20 bp, Artificial sequence
  Synthetic Oligonucleotide
gtgaggaaactgagagataa

SEQ ID NO: 2687 - DNA, 20 bp, Artificial sequence
  Synthetic Oligonucleotide
tgtagtatatgtgaggaaac

SEQ ID NO: 2688 - DNA, 20 bp, Artificial sequence
  Synthetic Oligonucleotide
atctttgtagtatatgtgag

SEQ ID NO: 2689 - DNA, 20 bp, Artificial sequence
  Synthetic Oligonucleotide
ttattatctttgtagtatat

SEQ ID NO: 2690 - DNA, 20 bp, Artificial sequence
  Synthetic Oligonucleotide
ttctgttattatctttgtag

SEQ ID NO: 2691 - DNA, 20 bp, Artificial sequence
  Synthetic Oligonucleotide
ataagttctgttattatctt

SEQ ID NO: 2692 - DNA, 20 bp, Artificial sequence
  Synthetic Oligonucleotide
atcctataagttctgttatt

SEQ ID NO: 2693 - DNA, 20 bp, Artificial sequence
  Synthetic Oligonucleotide
caataatcctataagttctg

SEQ ID NO: 2694 - DNA, 20 bp, Artificial sequence
  Synthetic Oligonucleotide
taagatgacattggctgcta

SEQ ID NO: 2695 - DNA, 20 bp, Artificial sequence
  Synthetic Oligonucleotide
tttagtaagatgacattggc

SEQ ID NO: 2696 - DNA, 20 bp, Artificial sequence
  Synthetic Oligonucleotide
ttgaattttagtaagatgac

SEQ ID NO: 2697 - DNA, 20 bp, Artificial sequence
  Synthetic Oligonucleotide
ctaatttgaattttagtaag

SEQ ID NO: 2698 - DNA, 20 bp, Artificial sequence
  Synthetic Oligonucleotide
catgatctaatttgaatttt

SEQ ID NO: 2699 - DNA, 20 bp, Artificial sequence
  Synthetic Oligonucleotide
caaagagaaacatgatctaa

SEQ ID NO: 2700 - DNA, 20 bp, Artificial sequence
  Synthetic Oligonucleotide
gttttgagcaaagagaaaca

SEQ ID NO: 2701 - DNA, 20 bp, Artificial sequence
  Synthetic Oligonucleotide
gtgtggttttgagcaaagag

SEQ ID NO: 2702 - DNA, 20 bp, Artificial sequence
  Synthetic Oligonucleotide
agctattgtgtggttttgag

SEQ ID NO: 2703 - DNA, 20 bp, Artificial sequence
  Synthetic Oligonucleotide
tgaaatggaaagctattgtg

SEQ ID NO: 2704 - DNA, 20 bp, Artificial sequence
  Synthetic Oligonucleotide
tatgagtgaaatggaaagct

SEQ ID NO: 2705 - DNA, 20 bp, Artificial sequence
  Synthetic Oligonucleotide
aaagagccaatatgagtgaa

SEQ ID NO: 2706 - DNA, 20 bp, Artificial sequence
  Synthetic Oligonucleotide
ttggtctaaagagccaatat

SEQ ID NO: 2707 - DNA, 20 bp, Artificial sequence
  Synthetic Oligonucleotide
ggtaatcttggtctaaagag

SEQ ID NO: 2708 - DNA, 20 bp, Artificial sequence
  Synthetic Oligonucleotide
gtgagatgacgaagggttgg

SEQ ID NO: 2709 - DNA, 20 bp, Artificial sequence
  Synthetic Oligonucleotide
agtcagtgagatgacgaagg

SEQ ID NO: 2710 - DNA, 20 bp, Artificial sequence
  Synthetic Oligonucleotide
ggtgaagtcagtgagatgac

SEQ ID NO: 2711 - DNA, 20 bp, Artificial sequence
  Synthetic Oligonucleotide
gtagaggaggtgaagtcagt

SEQ ID NO: 2712 - DNA, 20 bp, Artificial sequence
  Synthetic Oligonucleotide
aactagagtagaggaggtga

SEQ ID NO: 2713 - DNA, 20 bp, Artificial sequence
  Synthetic Oligonucleotide
agaataactagagtagagga

SEQ ID NO: 2714 - DNA, 20 bp, Artificial sequence
  Synthetic Oligonucleotide
cggtcagaataactagagta

SEQ ID NO: 2715 - DNA, 20 bp, Artificial sequence
  Synthetic Oligonucleotide
taaagcggtcagaataacta

SEQ ID NO: 2716 - DNA, 20 bp, Artificial sequence
  Synthetic Oligonucleotide
actggtaaagcggtcagaat

SEQ ID NO: 2717 - DNA, 20 bp, Artificial sequence
  Synthetic Oligonucleotide
tgaatactggtaaagcggtc

SEQ ID NO: 2718 - DNA, 20 bp, Artificial sequence
  Synthetic Oligonucleotide
tgtgtttgaatactggtaaa

SEQ ID NO: 2719 - DNA, 20 bp, Artificial sequence
  Synthetic Oligonucleotide
agtatgtttgatgtgtttga

SEQ ID NO: 2720 - DNA, 20 bp, Artificial sequence
  Synthetic Oligonucleotide
gtggcagtatgtttgatgtg

SEQ ID NO: 2721 - DNA, 20 bp, Artificial sequence
  Synthetic Oligonucleotide
ttgaggtggcagtatgtttg

SEQ ID NO: 2722 - DNA, 20 bp, Artificial sequence
  Synthetic Oligonucleotide
aggctttgaggtggcagtat

SEQ ID NO: 2723 - DNA, 20 bp, Artificial sequence
  Synthetic Oligonucleotide
ggcaaaggctttgaggtggc

SEQ ID NO: 2724 - DNA, 20 bp, Artificial sequence
  Synthetic Oligonucleotide
aacaagggcaaaggctttga

SEQ ID NO: 2725 - DNA, 20 bp, Artificial sequence
  Synthetic Oligonucleotide
tagaggaaacaacaagggca

SEQ ID NO: 2726 - DNA, 20 bp, Artificial sequence
  Synthetic Oligonucleotide
ccagttagaggaaacaacaa

SEQ ID NO: 2727 - DNA, 20 bp, Artificial sequence
  Synthetic Oligonucleotide
gataccagggcagaagagcg

SEQ ID NO: 2728 - DNA, 20 bp, Artificial sequence
  Synthetic Oligonucleotide
aaatcagagagtgggccacg

SEQ ID NO: 2729 - DNA, 20 bp, Artificial sequence
  Synthetic Oligonucleotide
cctaagggaaatcagagagt

SEQ ID NO: 2730 - DNA, 20 bp, Artificial sequence
  Synthetic Oligonucleotide
acgaccctaagggaaatcag

SEQ ID NO: 2731 - DNA, 20 bp, Artificial sequence
  Synthetic Oligonucleotide
tgataacgaccctaagggaa

SEQ ID NO: 2732 - DNA, 20 bp, Artificial sequence
  Synthetic Oligonucleotide
ttttgtttgataacgaccct

SEQ ID NO: 2733 - DNA, 20 bp, Artificial sequence
  Synthetic Oligonucleotide
gtcttcattgggaatttttt

SEQ ID NO: 2734 - DNA, 20 bp, Artificial sequence
  Synthetic Oligonucleotide
tgtaagtcttcattgggaat

SEQ ID NO: 2735 - DNA, 20 bp, Artificial sequence
  Synthetic Oligonucleotide
gaccttgtaagtcttcattg

SEQ ID NO: 2736 - DNA, 20 bp, Artificial sequence
  Synthetic Oligonucleotide
taagtgaccttgtaagtctt

SEQ ID NO: 2737 - DNA, 20 bp, Artificial sequence
  Synthetic Oligonucleotide
ttggttaagtgaccttgtaa

SEQ ID NO: 2738 - DNA, 20 bp, Artificial sequence
  Synthetic Oligonucleotide
tgatttttggttaagtgacc

SEQ ID NO: 2739 - DNA, 20 bp, Artificial sequence
  Synthetic Oligonucleotide
ggttgtgatttttggttaag

SEQ ID NO: 2740 - DNA, 20 bp, Artificial sequence
  Synthetic Oligonucleotide
caggcggttgtgatttttgg

SEQ ID NO: 2741 - DNA, 20 bp, Artificial sequence
  Synthetic Oligonucleotide
gggaccaggcggttgtgatt

SEQ ID NO: 2742 - DNA, 20 bp, Artificial sequence
  Synthetic Oligonucleotide
ctaaggaagtagaagttttc

SEQ ID NO: 2743 - DNA, 20 bp, Artificial sequence
  Synthetic Oligonucleotide
agtagctaaggaagtagaag

SEQ ID NO: 2744 - DNA, 20 bp, Artificial sequence
  Synthetic Oligonucleotide
caggagaaaagtagctaagg

SEQ ID NO: 2745 - DNA, 20 bp, Artificial sequence
  Synthetic Oligonucleotide
gtgtgcaggagaaaagtagc

SEQ ID NO: 2746 - DNA, 20 bp, Artificial sequence
  Synthetic Oligonucleotide
taaaggtgagtgtgcaggag

SEQ ID NO: 2747 - DNA, 20 bp, Artificial sequence
  Synthetic Oligonucleotide
atgttaaataaaggtgagtg

SEQ ID NO: 2748 - DNA, 20 bp, Artificial sequence
  Synthetic Oligonucleotide
atgttatgttaaataaaggt

SEQ ID NO: 2749 - DNA, 20 bp, Artificial sequence
  Synthetic Oligonucleotide
aatttatgttatgttaaata

SEQ ID NO: 2750 - DNA, 20 bp, Artificial sequence
  Synthetic Oligonucleotide
taactaaaatttatgttatg

SEQ ID NO: 2751 - DNA, 20 bp, Artificial sequence
  Synthetic Oligonucleotide
gataaataactaaaatttat

SEQ ID NO: 2752 - DNA, 20 bp, Artificial sequence
  Synthetic Oligonucleotide
tttagtgcaggaatagaaga

SEQ ID NO: 2753 - DNA, 20 bp, Artificial sequence
  Synthetic Oligonucleotide
aatccctgtattcacagagc

SEQ ID NO: 2754 - DNA, 20 bp, Artificial sequence
  Synthetic Oligonucleotide
gaaaaaatccctgtattcac

SEQ ID NO: 2755 - DNA, 20 bp, Artificial sequence
  Synthetic Oligonucleotide
taatggaaaaaatccctgta

SEQ ID NO: 2756 - DNA, 20 bp, Artificial sequence
  Synthetic Oligonucleotide
aaatatgaagataatggaaa

SEQ ID NO: 2757 - DNA, 20 bp, Artificial sequence
  Synthetic Oligonucleotide
ataatggaaaatatgaagat

SEQ ID NO: 2758 - DNA, 20 bp, Artificial sequence
  Synthetic Oligonucleotide
tatacaaataatggaaaata

SEQ ID NO: 2759 - DNA, 20 bp, Artificial sequence
  Synthetic Oligonucleotide
ttctggagtatatacaaata

SEQ ID NO: 2760 - DNA, 20 bp, Artificial sequence
  Synthetic Oligonucleotide
attctatattctggagtata

SEQ ID NO: 2761 - DNA, 20 bp, Artificial sequence
  Synthetic Oligonucleotide
ccatacagtattctatattc

SEQ ID NO: 2762 - DNA, 20 bp, Artificial sequence
  Synthetic Oligonucleotide
ctgtgtgccatacagtattc

SEQ ID NO: 2763 - DNA, 20 bp, Artificial sequence
  Synthetic Oligonucleotide
gcctactgtgtgccatacag

SEQ ID NO: 2764 - DNA, 20 bp, Artificial sequence
  Synthetic Oligonucleotide
agaaatgcctactgtgtgcc

SEQ ID NO: 2765 - DNA, 20 bp, Artificial sequence
  Synthetic Oligonucleotide
tcaacagaaatgcctactgt

SEQ ID NO: 2766 - DNA, 20 bp, Artificial sequence
  Synthetic Oligonucleotide
attaattcaacagaaatgcc

SEQ ID NO: 2767 - DNA, 20 bp, Artificial sequence
  Synthetic Oligonucleotide
gacattacatttattaattc

SEQ ID NO: 2768 - DNA, 20 bp, Artificial sequence
  Synthetic Oligonucleotide
gtgaatatgacattacattt

SEQ ID NO: 2769 - DNA, 20 bp, Artificial sequence
  Synthetic Oligonucleotide
cttctgtgtgaatatgacat

SEQ ID NO: 2770 - DNA, 20 bp, Artificial sequence
  Synthetic Oligonucleotide
acacgcttctgtgtgaatat

SEQ ID NO: 2771 - DNA, 20 bp, Artificial sequence
  Synthetic Oligonucleotide
atagcacacgcttctgtgtg

SEQ ID NO: 2772 - DNA, 20 bp, Artificial sequence
  Synthetic Oligonucleotide
taatcatagcacacgcttct

SEQ ID NO: 2773 - DNA, 20 bp, Artificial sequence
  Synthetic Oligonucleotide
aataataatcatagcacacg

SEQ ID NO: 2774 - DNA, 20 bp, Artificial sequence
  Synthetic Oligonucleotide
ccaagtaataataatcatag

SEQ ID NO: 2775 - DNA, 20 bp, Artificial sequence
  Synthetic Oligonucleotide
ctagtaatccaagtaataat

SEQ ID NO: 2776 - DNA, 20 bp, Artificial sequence
  Synthetic Oligonucleotide
tatttctagtaatccaagta

SEQ ID NO: 2777 - DNA, 20 bp, Artificial sequence
  Synthetic Oligonucleotide
cacactatttctagtaatcc

SEQ ID NO: 2778 - DNA, 20 bp, Artificial sequence
  Synthetic Oligonucleotide
ttatgaggcacactatttct

SEQ ID NO: 2779 - DNA, 20 bp, Artificial sequence
  Synthetic Oligonucleotide
tttaattatgaggcacacta

SEQ ID NO: 2780 - DNA, 20 bp, Artificial sequence
  Synthetic Oligonucleotide
gttgacctttaattatgagg

SEQ ID NO: 2781 - DNA, 20 bp, Artificial sequence
  Synthetic Oligonucleotide
ttacattgttgaatgttgac

SEQ ID NO: 2782 - DNA, 20 bp, Artificial sequence
  Synthetic Oligonucleotide
attaattacattgttgaatg

SEQ ID NO: 2783 - DNA, 20 bp, Artificial sequence
  Synthetic Oligonucleotide
tgtagattaattacattgtt

SEQ ID NO: 2784 - DNA, 20 bp, Artificial sequence
  Synthetic Oligonucleotide
tacattgtagattaattaca

SEQ ID NO: 2785 - DNA, 20 bp, Artificial sequence
  Synthetic Oligonucleotide
agatgtttacattgtagatt

SEQ ID NO: 2786 - DNA, 20 bp, Artificial sequence
  Synthetic Oligonucleotide
ttcaccagatgtttacattg

SEQ ID NO: 2787 - DNA, 20 bp, Artificial sequence
  Synthetic Oligonucleotide
gtcacttcaccagatgttta

SEQ ID NO: 2788 - DNA, 20 bp, Artificial sequence
  Synthetic Oligonucleotide
cctctgtcacttcaccagat

SEQ ID NO: 2789 - DNA, 20 bp, Artificial sequence
  Synthetic Oligonucleotide
gcttccctctgtcacttcac

SEQ ID NO: 2790 - DNA, 20 bp, Artificial sequence
  Synthetic Oligonucleotide
caagtgcttccctctgtcac

SEQ ID NO: 2791 - DNA, 20 bp, Artificial sequence
  Synthetic Oligonucleotide
gcttttttctaaacaagtgc

SEQ ID NO: 2792 - DNA, 20 bp, Artificial sequence
  Synthetic Oligonucleotide
acatagcttttttctaaaca

SEQ ID NO: 2793 - DNA, 20 bp, Artificial sequence
  Synthetic Oligonucleotide
ttctgacatagcttttttct

SEQ ID NO: 2794 - DNA, 20 bp, Artificial sequence
  Synthetic Oligonucleotide
atggattctgacatagcttt

SEQ ID NO: 2795 - DNA, 20 bp, Artificial sequence
  Synthetic Oligonucleotide
aatacatggattctgacata

SEQ ID NO: 2796 - DNA, 20 bp, Artificial sequence
  Synthetic Oligonucleotide
attagaatacatggattctg

SEQ ID NO: 2797 - DNA, 20 bp, Artificial sequence
  Synthetic Oligonucleotide
ttgtactgcatattagaata

SEQ ID NO: 2798 - DNA, 20 bp, Artificial sequence
  Synthetic Oligonucleotide
aactattgtactgcatatta

SEQ ID NO: 2799 - DNA, 20 bp, Artificial sequence
  Synthetic Oligonucleotide
ttttaaactattgtactgca

SEQ ID NO: 2800 - DNA, 20 bp, Artificial sequence
  Synthetic Oligonucleotide
tgagagtattattaatattt

SEQ ID NO: 2801 - DNA, 20 bp, Artificial sequence
  Synthetic Oligonucleotide
gctgtttgagagtattatta

SEQ ID NO: 2802 - DNA, 20 bp, Artificial sequence
  Synthetic Oligonucleotide
gaatagctgtttgagagtat

SEQ ID NO: 2803 - DNA, 20 bp, Artificial sequence
  Synthetic Oligonucleotide
cctcttgaatagctgtttga

SEQ ID NO: 2804 - DNA, 20 bp, Artificial sequence
  Synthetic Oligonucleotide
tgaatcctcttgaatagctg

SEQ ID NO: 2805 - DNA, 20 bp, Artificial sequence
  Synthetic Oligonucleotide
ttttttgaatcctcttgaat

SEQ ID NO: 2806 - DNA, 20 bp, Artificial sequence
  Synthetic Oligonucleotide
ttatgttttttgaatcctct

SEQ ID NO: 2807 - DNA, 20 bp, Artificial sequence
  Synthetic Oligonucleotide
gtttatattatgttttttga

SEQ ID NO: 2808 - DNA, 20 bp, Artificial sequence
  Synthetic Oligonucleotide
tctgagtttatattatgttt

SEQ ID NO: 2809 - DNA, 20 bp, Artificial sequence
  Synthetic Oligonucleotide
cagtttctctgagtttatat

SEQ ID NO: 2810 - DNA, 20 bp, Artificial sequence
  Synthetic Oligonucleotide
gtttaccagtttctctgagt

SEQ ID NO: 2811 - DNA, 20 bp, Artificial sequence
  Synthetic Oligonucleotide
attttgtttaccagtttctc

SEQ ID NO: 2812 - DNA, 20 bp, Artificial sequence
  Synthetic Oligonucleotide
aaatgattttgtttaccagt

SEQ ID NO: 2813 - DNA, 20 bp, Artificial sequence
  Synthetic Oligonucleotide
ctcttgaaaatgattttgtt

SEQ ID NO: 2814 - DNA, 20 bp, Artificial sequence
  Synthetic Oligonucleotide
tatatctcttgaaaatgatt

SEQ ID NO: 2815 - DNA, 20 bp, Artificial sequence
  Synthetic Oligonucleotide
caggttggcaagtttgtttg

SEQ ID NO: 2816 - DNA, 20 bp, Artificial sequence
  Synthetic Oligonucleotide
gttggcaggttggcaagttt

SEQ ID NO: 2817 - DNA, 20 bp, Artificial sequence
  Synthetic Oligonucleotide
atatctgtagatgttggcag

SEQ ID NO: 2818 - DNA, 20 bp, Artificial sequence
  Synthetic Oligonucleotide
taaacatatctgtagatgtt

SEQ ID NO: 2819 - DNA, 20 bp, Artificial sequence
  Synthetic Oligonucleotide
acctgtaaacatatctgtag

SEQ ID NO: 2820 - DNA, 20 bp, Artificial sequence
  Synthetic Oligonucleotide
ttttgacctgtaaacatatc

SEQ ID NO: 2821 - DNA, 20 bp, Artificial sequence
  Synthetic Oligonucleotide
ataatttttgacctgtaaac

SEQ ID NO: 2822 - DNA, 20 bp, Artificial sequence
  Synthetic Oligonucleotide
taatttgataatttttgacc

SEQ ID NO: 2823 - DNA, 20 bp, Artificial sequence
  Synthetic Oligonucleotide
ttcttgataatttgataatt

SEQ ID NO: 2824 - DNA, 20 bp, Artificial sequence
  Synthetic Oligonucleotide
accaggctttcttgataatt

SEQ ID NO: 2825 - DNA, 20 bp, Artificial sequence
  Synthetic Oligonucleotide
tttgaaccaggctttcttga

SEQ ID NO: 2826 - DNA, 20 bp, Artificial sequence
  Synthetic Oligonucleotide
agacataatacataatttga

SEQ ID NO: 2827 - DNA, 20 bp, Artificial sequence
  Synthetic Oligonucleotide
ctgtgataaagacataatac

SEQ ID NO: 2828 - DNA, 20 bp, Artificial sequence
  Synthetic Oligonucleotide
cagacctgtgataaagacat

SEQ ID NO: 2829 - DNA, 20 bp, Artificial sequence
  Synthetic Oligonucleotide
atcttcagacctgtgataaa

SEQ ID NO: 2830 - DNA, 20 bp, Artificial sequence
  Synthetic Oligonucleotide
tactgatcttcagacctgtg

SEQ ID NO: 2831 - DNA, 20 bp, Artificial sequence
  Synthetic Oligonucleotide
ttaataattttcagttttag

SEQ ID NO: 2832 - DNA, 20 bp, Artificial sequence
  Synthetic Oligonucleotide
taagtttaataattttcagt

SEQ ID NO: 2833 - DNA, 20 bp, Artificial sequence
  Synthetic Oligonucleotide
ttcagattttaagtttaata

SEQ ID NO: 2834 - DNA, 20 bp, Artificial sequence
  Synthetic Oligonucleotide
tatatttgatattctgttca

SEQ ID NO: 2835 - DNA, 20 bp, Artificial sequence
  Synthetic Oligonucleotide
atattgtaatgtattctttt

SEQ ID NO: 2836 - DNA, 20 bp, Artificial sequence
  Synthetic Oligonucleotide
ttagaatattgtaatgtatt

SEQ ID NO: 2837 - DNA, 20 bp, Artificial sequence
  Synthetic Oligonucleotide
tttgcttagaatattgtaat

SEQ ID NO: 2838 - DNA, 20 bp, Artificial sequence
  Synthetic Oligonucleotide
actgctttgcttagaatatt

SEQ ID NO: 2839 - DNA, 20 bp, Artificial sequence
  Synthetic Oligonucleotide
aagtagagactgctttgctt

SEQ ID NO: 2840 - DNA, 20 bp, Artificial sequence
  Synthetic Oligonucleotide
gcaaggccaaaagtagagac

SEQ ID NO: 2841 - DNA, 20 bp, Artificial sequence
  Synthetic Oligonucleotide
acagagcaaggccaaaagta

SEQ ID NO: 2842 - DNA, 20 bp, Artificial sequence
  Synthetic Oligonucleotide
ggaaaacagagcaaggccaa

SEQ ID NO: 2843 - DNA, 20 bp, Artificial sequence
  Synthetic Oligonucleotide
tggtcggaaaacagagcaag

SEQ ID NO: 2844 - DNA, 20 bp, Artificial sequence
  Synthetic Oligonucleotide
gacattggtcggaaaacaga

SEQ ID NO: 2845 - DNA, 20 bp, Artificial sequence
  Synthetic Oligonucleotide
aagcagacattggtcggaaa

SEQ ID NO: 2846 - DNA, 20 bp, Artificial sequence
  Synthetic Oligonucleotide
caaggcaaaaaagcagacat

SEQ ID NO: 2847 - DNA, 20 bp, Artificial sequence
  Synthetic Oligonucleotide
ataaagcaaggcaaaaaagc

SEQ ID NO: 2848 - DNA, 20 bp, Artificial sequence
  Synthetic Oligonucleotide
cattatttaataagataaaa

SEQ ID NO: 2849 - DNA, 20 bp, Artificial sequence
  Synthetic Oligonucleotide
aaatatttaatcagggacat

SEQ ID NO: 2850 - DNA, 20 bp, Artificial sequence
  Synthetic Oligonucleotide
tgttctcaaaatatttaatc

SEQ ID NO: 2851 - DNA, 20 bp, Artificial sequence
  Synthetic Oligonucleotide
gattacctgttctcaaaata

SEQ ID NO: 2852 - DNA, 20 bp, Artificial sequence
  Synthetic Oligonucleotide
gattgtacagattacctgtt

SEQ ID NO: 2853 - DNA, 20 bp, Artificial sequence
  Synthetic Oligonucleotide
attcagattgtacagattac

SEQ ID NO: 2854 - DNA, 20 bp, Artificial sequence
  Synthetic Oligonucleotide
aaacagtgttattcagattg

SEQ ID NO: 2855 - DNA, 20 bp, Artificial sequence
  Synthetic Oligonucleotide
tagataaacagtgttattca

SEQ ID NO: 2856 - DNA, 20 bp, Artificial sequence
  Synthetic Oligonucleotide
atatttagataaacagtgtt

SEQ ID NO: 2857 - DNA, 20 bp, Artificial sequence
  Synthetic Oligonucleotide
gtttgatatttagataaaca

SEQ ID NO: 2858 - DNA, 20 bp, Artificial sequence
  Synthetic Oligonucleotide
aacggtgtttgatatttaga

SEQ ID NO: 2859 - DNA, 20 bp, Artificial sequence
  Synthetic Oligonucleotide
gttataacggtgtttgatat

SEQ ID NO: 2860 - DNA, 20 bp, Artificial sequence
  Synthetic Oligonucleotide
ataatgttataacggtgttt

SEQ ID NO: 2861 - DNA, 20 bp, Artificial sequence
  Synthetic Oligonucleotide
agttcataatgttataacgg

SEQ ID NO: 2862 - DNA, 20 bp, Artificial sequence
  Synthetic Oligonucleotide
ctttcagttcataatgttat

SEQ ID NO: 2863 - DNA, 20 bp, Artificial sequence
  Synthetic Oligonucleotide
agtacagtttgtctttcagt

SEQ ID NO: 2864 - DNA, 20 bp, Artificial sequence
  Synthetic Oligonucleotide
tcagaagtacagtttgtctt

SEQ ID NO: 2865 - DNA, 20 bp, Artificial sequence
  Synthetic Oligonucleotide
ggatgtcagaagtacagttt

SEQ ID NO: 2866 - DNA, 20 bp, Artificial sequence
  Synthetic Oligonucleotide
gagtaaggatgtcagaagta

SEQ ID NO: 2867 - DNA, 20 bp, Artificial sequence
  Synthetic Oligonucleotide
gaaatctgagtaaggatgtc

SEQ ID NO: 2868 - DNA, 20 bp, Artificial sequence
  Synthetic Oligonucleotide
tactgaatatacaattaggg

SEQ ID NO: 2869 - DNA, 20 bp, Artificial sequence
  Synthetic Oligonucleotide
aatgatactgaatatacaat

SEQ ID NO: 2870 - DNA, 20 bp, Artificial sequence
  Synthetic Oligonucleotide
gaatataaatctgtttttta

SEQ ID NO: 2871 - DNA, 20 bp, Artificial sequence
  Synthetic Oligonucleotide
taaaagaatataaatctgtt

SEQ ID NO: 2872 - DNA, 20 bp, Artificial sequence
  Synthetic Oligonucleotide
gctgataaaagaatataaat

SEQ ID NO: 2873 - DNA, 20 bp, Artificial sequence
  Synthetic Oligonucleotide
ccttctgagctgataaaaga

SEQ ID NO: 2874 - DNA, 20 bp, Artificial sequence
  Synthetic Oligonucleotide
ctagtccttctgagctgata

SEQ ID NO: 2875 - DNA, 20 bp, Artificial sequence
  Synthetic Oligonucleotide
ttaccatcatgttttacatt

SEQ ID NO: 2876 - DNA, 20 bp, Artificial sequence
  Synthetic Oligonucleotide
caaagtgtcttaccatcatg

SEQ ID NO: 2877 - DNA, 20 bp, Artificial sequence
  Synthetic Oligonucleotide
aaacccaccaaagtgtctta

SEQ ID NO: 2878 - DNA, 20 bp, Artificial sequence
  Synthetic Oligonucleotide
agaaggaaacccaccaaagt

SEQ ID NO: 2879 - DNA, 20 bp, Artificial sequence
  Synthetic Oligonucleotide
aataatagcttcaagaagga

SEQ ID NO: 2880 - DNA, 20 bp, Artificial sequence
  Synthetic Oligonucleotide
aatttgataataatagcttc

SEQ ID NO: 2881 - DNA, 20 bp, Artificial sequence
  Synthetic Oligonucleotide
tagggaatttgataataata

SEQ ID NO: 2882 - DNA, 20 bp, Artificial sequence
  Synthetic Oligonucleotide
aagaatagggaatttgataa

SEQ ID NO: 2883 - DNA, 20 bp, Artificial sequence
  Synthetic Oligonucleotide
gtcctaagaatagggaattt

SEQ ID NO: 2884 - DNA, 20 bp, Artificial sequence
  Synthetic Oligonucleotide
tagaacaagtcctaagaata

SEQ ID NO: 2885 - DNA, 20 bp, Artificial sequence
  Synthetic Oligonucleotide
ttagtctagaacaagtccta

SEQ ID NO: 2886 - DNA, 20 bp, Artificial sequence
  Synthetic Oligonucleotide
atcttttagtctagaacaag

SEQ ID NO: 2887 - DNA, 20 bp, Artificial sequence
  Synthetic Oligonucleotide
taactatcttttagtctaga

SEQ ID NO: 2888 - DNA, 20 bp, Artificial sequence
  Synthetic Oligonucleotide
atctcttaactatcttttag

SEQ ID NO: 2889 - DNA, 20 bp, Artificial sequence
  Synthetic Oligonucleotide
tggatatctcttaactatct

SEQ ID NO: 2890 - DNA, 20 bp, Artificial sequence
  Synthetic Oligonucleotide
tttgatggatatctcttaac

SEQ ID NO: 2891 - DNA, 20 bp, Artificial sequence
  Synthetic Oligonucleotide
ttaattctgcttcattaggt

SEQ ID NO: 2892 - DNA, 20 bp, Artificial sequence
  Synthetic Oligonucleotide
tttaattctgcttcattagg

SEQ ID NO: 2893 - DNA, 20 bp, Artificial sequence
  Synthetic Oligonucleotide
cagtatttaattctgcttca

SEQ ID NO: 2894 - DNA, 20 bp, Artificial sequence
  Synthetic Oligonucleotide
acagtatttaattctgcttc

SEQ ID NO: 2895 - DNA, 20 bp, Artificial sequence
  Synthetic Oligonucleotide
tacagtatttaattctgctt

SEQ ID NO: 2896 - DNA, 20 bp, Artificial sequence
  Synthetic Oligonucleotide
atacagtatttaattctgct

SEQ ID NO: 2897 - DNA, 20 bp, Artificial sequence
  Synthetic Oligonucleotide
aatacagtatttaattctgc

SEQ ID NO: 2898 - DNA, 20 bp, Artificial sequence
  Synthetic Oligonucleotide
taatacagtatttaattctg

SEQ ID NO: 2899 - DNA, 20 bp, Artificial sequence
  Synthetic Oligonucleotide
tttaatacagtatttaattc

SEQ ID NO: 2900 - DNA, 20 bp, Artificial sequence
  Synthetic Oligonucleotide
ttttaatacagtatttaatt

SEQ ID NO: 2901 - DNA, 20 bp, Artificial sequence
  Synthetic Oligonucleotide
ttattttaatacagtattta

SEQ ID NO: 2902 - DNA, 20 bp, Artificial sequence
  Synthetic Oligonucleotide
aacttattttaatacagtat

SEQ ID NO: 2903 - DNA, 20 bp, Artificial sequence
  Synthetic Oligonucleotide
gaacttattttaatacagta

SEQ ID NO: 2904 - DNA, 20 bp, Artificial sequence
  Synthetic Oligonucleotide
cgaacttattttaatacagt

SEQ ID NO: 2905 - DNA, 20 bp, Artificial sequence
  Synthetic Oligonucleotide
gcgaacttattttaatacag

SEQ ID NO: 2906 - DNA, 20 bp, Artificial sequence
  Synthetic Oligonucleotide
agcgaacttattttaataca

SEQ ID NO: 2907 - DNA, 20 bp, Artificial sequence
  Synthetic Oligonucleotide
cagcgaacttattttaatac

SEQ ID NO: 2908 - DNA, 20 bp, Artificial sequence
  Synthetic Oligonucleotide
acagcgaacttattttaata

SEQ ID NO: 2909 - DNA, 20 bp, Artificial sequence
  Synthetic Oligonucleotide
gacagcgaacttattttaat

SEQ ID NO: 2910 - DNA, 20 bp, Artificial sequence
  Synthetic Oligonucleotide
agacagcgaacttattttaa

SEQ ID NO: 2911 - DNA, 20 bp, Artificial sequence
  Synthetic Oligonucleotide
aaagacagcgaacttatttt

SEQ ID NO: 2912 - DNA, 20 bp, Artificial sequence
  Synthetic Oligonucleotide
taaagacagcgaacttattt

SEQ ID NO: 2913 - DNA, 20 bp, Artificial sequence
  Synthetic Oligonucleotide
gtttaaagacagcgaactta

SEQ ID NO: 2914 - DNA, 20 bp, Artificial sequence
  Synthetic Oligonucleotide
tgtttaaagacagcgaactt

SEQ ID NO: 2915 - DNA, 20 bp, Artificial sequence
  Synthetic Oligonucleotide
ttgtttaaagacagcgaact

SEQ ID NO: 2916 - DNA, 20 bp, Artificial sequence
  Synthetic Oligonucleotide
tttgtttaaagacagcgaac

SEQ ID NO: 2917 - DNA, 20 bp, Artificial sequence
  Synthetic Oligonucleotide
atttgtttaaagacagcgaa

SEQ ID NO: 2918 - DNA, 20 bp, Artificial sequence
  Synthetic Oligonucleotide
catttgtttaaagacagcga

SEQ ID NO: 2919 - DNA, 20 bp, Artificial sequence
  Synthetic Oligonucleotide
tccatttgtttaaagacagc

SEQ ID NO: 2920 - DNA, 20 bp, Artificial sequence
  Synthetic Oligonucleotide
ctccatttgtttaaagacag

SEQ ID NO: 2921 - DNA, 20 bp, Artificial sequence
  Synthetic Oligonucleotide
atctccatttgtttaaagac

SEQ ID NO: 2922 - DNA, 20 bp, Artificial sequence
  Synthetic Oligonucleotide
catctccatttgtttaaaga

SEQ ID NO: 2923 - DNA, 20 bp, Artificial sequence
  Synthetic Oligonucleotide
tcatctccatttgtttaaag

SEQ ID NO: 2924 - DNA, 20 bp, Artificial sequence
  Synthetic Oligonucleotide
gtcatctccatttgtttaaa

SEQ ID NO: 2925 - DNA, 20 bp, Artificial sequence
  Synthetic Oligonucleotide
tagtcatctccatttgttta

SEQ ID NO: 2926 - DNA, 20 bp, Artificial sequence
  Synthetic Oligonucleotide
gtagtcatctccatttgttt

SEQ ID NO: 2927 - DNA, 20 bp, Artificial sequence
  Synthetic Oligonucleotide
agtagtcatctccatttgtt

SEQ ID NO: 2928 - DNA, 20 bp, Artificial sequence
  Synthetic Oligonucleotide
tagtagtcatctccatttgt

SEQ ID NO: 2929 - DNA, 20 bp, Artificial sequence
  Synthetic Oligonucleotide
ttagtagtcatctccatttg

SEQ ID NO: 2930 - DNA, 20 bp, Artificial sequence
  Synthetic Oligonucleotide
cttagtagtcatctccattt

SEQ ID NO: 2931 - DNA, 20 bp, Artificial sequence
  Synthetic Oligonucleotide
gtgacttagtagtcatctcc

SEQ ID NO: 2932 - DNA, 20 bp, Artificial sequence
  Synthetic Oligonucleotide
tgtgacttagtagtcatctc

SEQ ID NO: 2933 - DNA, 20 bp, Artificial sequence
  Synthetic Oligonucleotide
atgtgacttagtagtcatct

SEQ ID NO: 2934 - DNA, 20 bp, Artificial sequence
  Synthetic Oligonucleotide
aatgtgacttagtagtcatc

SEQ ID NO: 2935 - DNA, 20 bp, Artificial sequence
  Synthetic Oligonucleotide
caatgtgacttagtagtcat

SEQ ID NO: 2936 - DNA, 20 bp, Artificial sequence
  Synthetic Oligonucleotide
tcaatgtgacttagtagtca

SEQ ID NO: 2937 - DNA, 20 bp, Artificial sequence
  Synthetic Oligonucleotide
agtcaatgtgacttagtagt

SEQ ID NO: 2938 - DNA, 20 bp, Artificial sequence
  Synthetic Oligonucleotide
ttaaagtcaatgtgacttag

SEQ ID NO: 2939 - DNA, 20 bp, Artificial sequence
  Synthetic Oligonucleotide
gttaaagtcaatgtgactta

SEQ ID NO: 2940 - DNA, 20 bp, Artificial sequence
  Synthetic Oligonucleotide
tgttaaagtcaatgtgactt

SEQ ID NO: 2941 - DNA, 20 bp, Artificial sequence
  Synthetic Oligonucleotide
atgttaaagtcaatgtgact

SEQ ID NO: 2942 - DNA, 20 bp, Artificial sequence
  Synthetic Oligonucleotide
catgttaaagtcaatgtgac

SEQ ID NO: 2943 - DNA, 20 bp, Artificial sequence
  Synthetic Oligonucleotide
ctcatgttaaagtcaatgtg

SEQ ID NO: 2944 - DNA, 20 bp, Artificial sequence
  Synthetic Oligonucleotide
cctcatgttaaagtcaatgt

SEQ ID NO: 2945 - DNA, 20 bp, Artificial sequence
  Synthetic Oligonucleotide
acctcatgttaaagtcaatg

SEQ ID NO: 2946 - DNA, 20 bp, Artificial sequence
  Synthetic Oligonucleotide
tacctcatgttaaagtcaat

SEQ ID NO: 2947 - DNA, 20 bp, Artificial sequence
  Synthetic Oligonucleotide
atacctcatgttaaagtcaa

SEQ ID NO: 2948 - DNA, 20 bp, Artificial sequence
  Synthetic Oligonucleotide
gatacctcatgttaaagtca

SEQ ID NO: 2949 - DNA, 20 bp, Artificial sequence
  Synthetic Oligonucleotide
tgatacctcatgttaaagtc

SEQ ID NO: 2950 - DNA, 20 bp, Artificial sequence
  Synthetic Oligonucleotide
gtgatacctcatgttaaagt

SEQ ID NO: 2951 - DNA, 20 bp, Artificial sequence
  Synthetic Oligonucleotide
agtgatacctcatgttaaag

SEQ ID NO: 2952 - DNA, 20 bp, Artificial sequence
  Synthetic Oligonucleotide
tagtgatacctcatgttaaa

SEQ ID NO: 2953 - DNA, 20 bp, Artificial sequence
  Synthetic Oligonucleotide
atagtgatacctcatgttaa

SEQ ID NO: 2954 - DNA, 20 bp, Artificial sequence
  Synthetic Oligonucleotide
tatagtgatacctcatgtta

SEQ ID NO: 2955 - DNA, 20 bp, Artificial sequence
  Synthetic Oligonucleotide
gtatagtgatacctcatgtt

SEQ ID NO: 2956 - DNA, 20 bp, Artificial sequence
  Synthetic Oligonucleotide
ggtatagtgatacctcatgt

SEQ ID NO: 2957 - DNA, 20 bp, Artificial sequence
  Synthetic Oligonucleotide
ataaggtatagtgatacctc

SEQ ID NO: 2958 - DNA, 20 bp, Artificial sequence
  Synthetic Oligonucleotide
aataaggtatagtgatacct

SEQ ID NO: 2959 - DNA, 20 bp, Artificial sequence
  Synthetic Oligonucleotide
taatgtttaaattattgcct

SEQ ID NO: 2960 - DNA, 20 bp, Artificial sequence
  Synthetic Oligonucleotide
ggttaatgtttaaattattg

SEQ ID NO: 2961 - DNA, 20 bp, Artificial sequence
  Synthetic Oligonucleotide
aggttaatgtttaaattatt

SEQ ID NO: 2962 - DNA, 20 bp, Artificial sequence
  Synthetic Oligonucleotide
gaggttaatgtttaaattat

SEQ ID NO: 2963 - DNA, 20 bp, Artificial sequence
  Synthetic Oligonucleotide
tgaggttaatgtttaaatta

SEQ ID NO: 2964 - DNA, 20 bp, Artificial sequence
  Synthetic Oligonucleotide
aatgaggttaatgtttaaat

SEQ ID NO: 2965 - DNA, 20 bp, Artificial sequence
  Synthetic Oligonucleotide
gaatgaggttaatgtttaaa

SEQ ID NO: 2966 - DNA, 20 bp, Artificial sequence
  Synthetic Oligonucleotide
ggaatgaggttaatgtttaa

SEQ ID NO: 2967 - DNA, 20 bp, Artificial sequence
  Synthetic Oligonucleotide
tggaatgaggttaatgttta

SEQ ID NO: 2968 - DNA, 20 bp, Artificial sequence
  Synthetic Oligonucleotide
ttggaatgaggttaatgttt

SEQ ID NO: 2969 - DNA, 20 bp, Artificial sequence
  Synthetic Oligonucleotide
cttggaatgaggttaatgtt

SEQ ID NO: 2970 - DNA, 20 bp, Artificial sequence
  Synthetic Oligonucleotide
taacttggaatgaggttaat

SEQ ID NO: 2971 - DNA, 20 bp, Artificial sequence
  Synthetic Oligonucleotide
ttaacttggaatgaggttaa

SEQ ID NO: 2972 - DNA, 20 bp, Artificial sequence
  Synthetic Oligonucleotide
attaacttggaatgaggtta

SEQ ID NO: 2973 - DNA, 20 bp, Artificial sequence
  Synthetic Oligonucleotide
cattaacttggaatgaggtt

SEQ ID NO: 2974 - DNA, 20 bp, Artificial sequence
  Synthetic Oligonucleotide
acattaacttggaatgaggt

SEQ ID NO: 2975 - DNA, 20 bp, Artificial sequence
  Synthetic Oligonucleotide
accacattaacttggaatga

SEQ ID NO: 2976 - DNA, 20 bp, Artificial sequence
  Synthetic Oligonucleotide
gaccacattaacttggaatg

SEQ ID NO: 2977 - DNA, 20 bp, Artificial sequence
  Synthetic Oligonucleotide
agaccacattaacttggaat

SEQ ID NO: 2978 - DNA, 20 bp, Artificial sequence
  Synthetic Oligonucleotide
tagaccacattaacttggaa

SEQ ID NO: 2979 - DNA, 20 bp, Artificial sequence
  Synthetic Oligonucleotide
ttagaccacattaacttgga

SEQ ID NO: 2980 - DNA, 20 bp, Artificial sequence
  Synthetic Oligonucleotide
attagaccacattaacttgg

SEQ ID NO: 2981 - DNA, 20 bp, Artificial sequence
  Synthetic Oligonucleotide
tattagaccacattaacttg

SEQ ID NO: 2982 - DNA, 20 bp, Artificial sequence
  Synthetic Oligonucleotide
ttattagaccacattaactt

SEQ ID NO: 2983 - DNA, 20 bp, Artificial sequence
  Synthetic Oligonucleotide
attattagaccacattaact

SEQ ID NO: 2984 - DNA, 20 bp, Artificial sequence
  Synthetic Oligonucleotide
gattattagaccacattaac

SEQ ID NO: 2985 - DNA, 20 bp, Artificial sequence
  Synthetic Oligonucleotide
aataccagattattagacca

SEQ ID NO: 2986 - DNA, 20 bp, Artificial sequence
  Synthetic Oligonucleotide
taataccagattattagacc

SEQ ID NO: 2987 - DNA, 20 bp, Artificial sequence
  Synthetic Oligonucleotide
tttaataccagattattaga

SEQ ID NO: 2988 - DNA, 20 bp, Artificial sequence
  Synthetic Oligonucleotide
atttaataccagattattag

SEQ ID NO: 2989 - DNA, 20 bp, Artificial sequence
  Synthetic Oligonucleotide
gatttaataccagattatta

SEQ ID NO: 2990 - DNA, 20 bp, Artificial sequence
  Synthetic Oligonucleotide
taaggatttaataccagatt

SEQ ID NO: 2991 - DNA, 20 bp, Artificial sequence
  Synthetic Oligonucleotide
tttctcttaaggatttaata

SEQ ID NO: 2992 - DNA, 20 bp, Artificial sequence
  Synthetic Oligonucleotide
ctttctcttaaggatttaat

SEQ ID NO: 2993 - DNA, 20 bp, Artificial sequence
  Synthetic Oligonucleotide
agctttctcttaaggattta

SEQ ID NO: 2994 - DNA, 20 bp, Artificial sequence
  Synthetic Oligonucleotide
aagctttctcttaaggattt

SEQ ID NO: 2995 - DNA, 20 bp, Artificial sequence
  Synthetic Oligonucleotide
tcaagctttctcttaaggat

SEQ ID NO: 2996 - DNA, 20 bp, Artificial sequence
  Synthetic Oligonucleotide
ttctcaagctttctcttaag

SEQ ID NO: 2997 - DNA, 20 bp, Artificial sequence
  Synthetic Oligonucleotide
tttctcaagctttctcttaa

SEQ ID NO: 2998 - DNA, 20 bp, Artificial sequence
  Synthetic Oligonucleotide
tctatttctcaagctttctc

SEQ ID NO: 2999 - DNA, 20 bp, Artificial sequence
  Synthetic Oligonucleotide
atctatttctcaagctttct

SEQ ID NO: 3000 - DNA, 20 bp, Artificial sequence
  Synthetic Oligonucleotide
aatctatttctcaagctttc

SEQ ID NO: 3001 - DNA, 20 bp, Artificial sequence
  Synthetic Oligonucleotide
aaatctatttctcaagcttt

SEQ ID NO: 3002 - DNA, 20 bp, Artificial sequence
  Synthetic Oligonucleotide
aaaatctatttctcaagctt

SEQ ID NO: 3003 - DNA, 20 bp, Artificial sequence
  Synthetic Oligonucleotide
gataaaaaaaatctatttct

SEQ ID NO: 3004 - DNA, 20 bp, Artificial sequence
  Synthetic Oligonucleotide
tagacagtgactttaagata

SEQ ID NO: 3005 - DNA, 20 bp, Artificial sequence
  Synthetic Oligonucleotide
atagacagtgactttaagat

SEQ ID NO: 3006 - DNA, 20 bp, Artificial sequence
  Synthetic Oligonucleotide
aatagacagtgactttaaga

SEQ ID NO: 3007 - DNA, 20 bp, Artificial sequence
  Synthetic Oligonucleotide
aaatagacagtgactttaag

SEQ ID NO: 3008 - DNA, 20 bp, Artificial sequence
  Synthetic Oligonucleotide
taaatagacagtgactttaa

SEQ ID NO: 3009 - DNA, 20 bp, Artificial sequence
  Synthetic Oligonucleotide
ttaaatagacagtgacttta

SEQ ID NO: 3010 - DNA, 20 bp, Artificial sequence
  Synthetic Oligonucleotide
cttaaatagacagtgacttt

SEQ ID NO: 3011 - DNA, 20 bp, Artificial sequence
  Synthetic Oligonucleotide
tcttaaatagacagtgactt

SEQ ID NO: 3012 - DNA, 20 bp, Artificial sequence
  Synthetic Oligonucleotide
atcttaaatagacagtgact

SEQ ID NO: 3013 - DNA, 20 bp, Artificial sequence
  Synthetic Oligonucleotide
aatcttaaatagacagtgac

SEQ ID NO: 3014 - DNA, 20 bp, Artificial sequence
  Synthetic Oligonucleotide
taatcttaaatagacagtga

SEQ ID NO: 3015 - DNA, 20 bp, Artificial sequence
  Synthetic Oligonucleotide
ttaatcttaaatagacagtg

SEQ ID NO: 3016 - DNA, 20 bp, Artificial sequence
  Synthetic Oligonucleotide
tttaatcttaaatagacagt

SEQ ID NO: 3017 - DNA, 20 bp, Artificial sequence
  Synthetic Oligonucleotide
gtttaatcttaaatagacag

SEQ ID NO: 3018 - DNA, 20 bp, Artificial sequence
  Synthetic Oligonucleotide
tgtttaatcttaaatagaca

SEQ ID NO: 3019 - DNA, 20 bp, Artificial sequence
  Synthetic Oligonucleotide
atgtttaatcttaaatagac

SEQ ID NO: 3020 - DNA, 20 bp, Artificial sequence
  Synthetic Oligonucleotide
ttgtatgtttaatcttaaat

SEQ ID NO: 3021 - DNA, 20 bp, Artificial sequence
  Synthetic Oligonucleotide
attgtatgtttaatcttaaa

SEQ ID NO: 3022 - DNA, 20 bp, Artificial sequence
  Synthetic Oligonucleotide
gattgtatgtttaatcttaa

SEQ ID NO: 3023 - DNA, 20 bp, Artificial sequence
  Synthetic Oligonucleotide
tgattgtatgtttaatctta

SEQ ID NO: 3024 - DNA, 20 bp, Artificial sequence
  Synthetic Oligonucleotide
tatgtgattgtatgtttaat

SEQ ID NO: 3025 - DNA, 20 bp, Artificial sequence
  Synthetic Oligonucleotide
gttatgtgattgtatgttta

SEQ ID NO: 3026 - DNA, 20 bp, Artificial sequence
  Synthetic Oligonucleotide
taaggttatgtgattgtatg

SEQ ID NO: 3027 - DNA, 20 bp, Artificial sequence
  Synthetic Oligonucleotide
ttaaggttatgtgattgtat

SEQ ID NO: 3028 - DNA, 20 bp, Artificial sequence
  Synthetic Oligonucleotide
ttctttaaggttatgtgatt

SEQ ID NO: 3029 - DNA, 16 bp, Artificial sequence
  Synthetic Oligonucleotide
tctggaagcagaccta

SEQ ID NO: 3030 - DNA, 16 bp, Artificial sequence
  Synthetic Oligonucleotide
cttctggaagcagacc

SEQ ID NO: 3031 - DNA, 16 bp, Artificial sequence
  Synthetic Oligonucleotide
aaataaggtatagtga

SEQ ID NO: 3032 - DNA, 16 bp, Artificial sequence
  Synthetic Oligonucleotide
tagtattaagtgttaa

SEQ ID NO: 3033 - DNA, 16 bp, Artificial sequence
  Synthetic Oligonucleotide
tcatagtattaagtgt

SEQ ID NO: 3034 - DNA, 16 bp, Artificial sequence
  Synthetic Oligonucleotide
agattcctttacaatt

SEQ ID NO: 3035 - DNA, 16 bp, Artificial sequence
  Synthetic Oligonucleotide
acaagattcctttaca

SEQ ID NO: 3036 - DNA, 16 bp, Artificial sequence
  Synthetic Oligonucleotide
ctgacaagattccttt

SEQ ID NO: 3037 - DNA, 16 bp, Artificial sequence
  Synthetic Oligonucleotide
tgtaatctgacaagat

SEQ ID NO: 3038 - DNA, 16 bp, Artificial sequence
  Synthetic Oligonucleotide
tactgtaatctgacaa

SEQ ID NO: 3039 - DNA, 16 bp, Artificial sequence
  Synthetic Oligonucleotide
tcttactgtaatctga

SEQ ID NO: 3040 - DNA, 16 bp, Artificial sequence
  Synthetic Oligonucleotide
cattcttactgtaatc

SEQ ID NO: 3041 - DNA, 16 bp, Artificial sequence
  Synthetic Oligonucleotide
gttcattcttactgta

SEQ ID NO: 3042 - DNA, 16 bp, Artificial sequence
  Synthetic Oligonucleotide
atatgttcattcttac

SEQ ID NO: 3043 - DNA, 16 bp, Artificial sequence
  Synthetic Oligonucleotide
gccacaaatatgttca

SEQ ID NO: 3044 - DNA, 16 bp, Artificial sequence
  Synthetic Oligonucleotide
gatgccacaaatatgt

SEQ ID NO: 3045 - DNA, 16 bp, Artificial sequence
  Synthetic Oligonucleotide
ctttaactcgatgcca

SEQ ID NO: 3046 - DNA, 16 bp, Artificial sequence
  Synthetic Oligonucleotide
aaactttaactcgatg

SEQ ID NO: 3047 - DNA, 16 bp, Artificial sequence
  Synthetic Oligonucleotide
tataaactttaactcg

SEQ ID NO: 3048 - DNA, 16 bp, Artificial sequence
  Synthetic Oligonucleotide
cacagcatatttaggg

SEQ ID NO: 3049 - DNA, 16 bp, Artificial sequence
  Synthetic Oligonucleotide
tagaatcacagcatat

SEQ ID NO: 3050 - DNA, 16 bp, Artificial sequence
  Synthetic Oligonucleotide
tattagaatcacagca

SEQ ID NO: 3051 - DNA, 16 bp, Artificial sequence
  Synthetic Oligonucleotide
aatgtattagaatcac

SEQ ID NO: 3052 - DNA, 16 bp, Artificial sequence
  Synthetic Oligonucleotide
acgaatgtattagaat

SEQ ID NO: 3053 - DNA, 16 bp, Artificial sequence
  Synthetic Oligonucleotide
tacacgaatgtattag

SEQ ID NO: 3054 - DNA, 16 bp, Artificial sequence
  Synthetic Oligonucleotide
acctacacgaatgtat

SEQ ID NO: 3055 - DNA, 16 bp, Artificial sequence
  Synthetic Oligonucleotide
aaaacctacacgaatg

SEQ ID NO: 3056 - DNA, 16 bp, Artificial sequence
  Synthetic Oligonucleotide
ttgaaaacctacacga

SEQ ID NO: 3057 - DNA, 16 bp, Artificial sequence
  Synthetic Oligonucleotide
tacttgaaaacctaca

SEQ ID NO: 3058 - DNA, 16 bp, Artificial sequence
  Synthetic Oligonucleotide
gtttatttctacttga

SEQ ID NO: 3059 - DNA, 16 bp, Artificial sequence
  Synthetic Oligonucleotide
gaggtttatttctact

SEQ ID NO: 3060 - DNA, 16 bp, Artificial sequence
  Synthetic Oligonucleotide
tacgaggtttatttct

SEQ ID NO: 3061 - DNA, 16 bp, Artificial sequence
  Synthetic Oligonucleotide
tgttacgaggtttatt

SEQ ID NO: 3062 - DNA, 16 bp, Artificial sequence
  Synthetic Oligonucleotide
acttgttacgaggttt

SEQ ID NO: 3063 - DNA, 16 bp, Artificial sequence
  Synthetic Oligonucleotide
cagtaacttgttacga

SEQ ID NO: 3064 - DNA, 16 bp, Artificial sequence
  Synthetic Oligonucleotide
gttcagtaacttgtta

SEQ ID NO: 3065 - DNA, 16 bp, Artificial sequence
  Synthetic Oligonucleotide
tcaggctgtttaaacg

SEQ ID NO: 3066 - DNA, 16 bp, Artificial sequence
  Synthetic Oligonucleotide
ttgtcaggctgtttaa

SEQ ID NO: 3067 - DNA, 16 bp, Artificial sequence
  Synthetic Oligonucleotide
tatacatgcttgtcag

SEQ ID NO: 3068 - DNA, 16 bp, Artificial sequence
  Synthetic Oligonucleotide
gtctttgtttattgaa

SEQ ID NO: 3069 - DNA, 16 bp, Artificial sequence
  Synthetic Oligonucleotide
tgggtctttgtttatt

SEQ ID NO: 3070 - DNA, 16 bp, Artificial sequence
  Synthetic Oligonucleotide
gactgggtctttgttt

SEQ ID NO: 3071 - DNA, 16 bp, Artificial sequence
  Synthetic Oligonucleotide
ataatttagggactgg

SEQ ID NO: 3072 - DNA, 16 bp, Artificial sequence
  Synthetic Oligonucleotide
tctataatttagggac

SEQ ID NO: 3073 - DNA, 16 bp, Artificial sequence
  Synthetic Oligonucleotide
cgataaacatgcaaga

SEQ ID NO: 3074 - DNA, 16 bp, Artificial sequence
  Synthetic Oligonucleotide
tgtcgataaacatgca

SEQ ID NO: 3075 - DNA, 16 bp, Artificial sequence
  Synthetic Oligonucleotide
tgatgtcgataaacat

SEQ ID NO: 3076 - DNA, 16 bp, Artificial sequence
  Synthetic Oligonucleotide
ttgtgatgtcgataaa

SEQ ID NO: 3077 - DNA, 16 bp, Artificial sequence
  Synthetic Oligonucleotide
ctgttgtgatgtcgat

SEQ ID NO: 3078 - DNA, 16 bp, Artificial sequence
  Synthetic Oligonucleotide
gatctgttgtgatgtc

SEQ ID NO: 3079 - DNA, 16 bp, Artificial sequence
  Synthetic Oligonucleotide
agggatctgttgtgat

SEQ ID NO: 3080 - DNA, 16 bp, Artificial sequence
  Synthetic Oligonucleotide
tttagggatctgttgt

SEQ ID NO: 3081 - DNA, 16 bp, Artificial sequence
  Synthetic Oligonucleotide
ggatttagggatctgt

SEQ ID NO: 3082 - DNA, 16 bp, Artificial sequence
  Synthetic Oligonucleotide
gatttagggatttagg

SEQ ID NO: 3083 - DNA, 16 bp, Artificial sequence
  Synthetic Oligonucleotide
tctttagggatttagg

SEQ ID NO: 3084 - DNA, 16 bp, Artificial sequence
  Synthetic Oligonucleotide
taatctttagggattt

SEQ ID NO: 3085 - DNA, 16 bp, Artificial sequence
  Synthetic Oligonucleotide
atctaatctttaggga

SEQ ID NO: 3086 - DNA, 16 bp, Artificial sequence
  Synthetic Oligonucleotide
tgtatctaatctttag

SEQ ID NO: 3087 - DNA, 16 bp, Artificial sequence
  Synthetic Oligonucleotide
aaatttgtatctaatc

SEQ ID NO: 3088 - DNA, 16 bp, Artificial sequence
  Synthetic Oligonucleotide
gtaaaaaatttgtatc

SEQ ID NO: 3089 - DNA, 16 bp, Artificial sequence
  Synthetic Oligonucleotide
gtggtaaaaaatttgt

SEQ ID NO: 3090 - DNA, 16 bp, Artificial sequence
  Synthetic Oligonucleotide
gatactgtggtaaaaa

SEQ ID NO: 3091 - DNA, 16 bp, Artificial sequence
  Synthetic Oligonucleotide
agtgatactgtggtaa

SEQ ID NO: 3092 - DNA, 16 bp, Artificial sequence
  Synthetic Oligonucleotide
acaagtgatactgtgg

SEQ ID NO: 3093 - DNA, 16 bp, Artificial sequence
  Synthetic Oligonucleotide
ctgacaagtgatactg

SEQ ID NO: 3094 - DNA, 16 bp, Artificial sequence
  Synthetic Oligonucleotide
attctgacaagtgata

SEQ ID NO: 3095 - DNA, 16 bp, Artificial sequence
  Synthetic Oligonucleotide
taaattctgacaagtg

SEQ ID NO: 3096 - DNA, 16 bp, Artificial sequence
  Synthetic Oligonucleotide
tactggcagttttaaa

SEQ ID NO: 3097 - DNA, 16 bp, Artificial sequence
  Synthetic Oligonucleotide
tcttactggcagtttt

SEQ ID NO: 3098 - DNA, 16 bp, Artificial sequence
  Synthetic Oligonucleotide
atttcttactggcagt

SEQ ID NO: 3099 - DNA, 16 bp, Artificial sequence
  Synthetic Oligonucleotide
aaaatttcttactggc

SEQ ID NO: 3100 - DNA, 16 bp, Artificial sequence
  Synthetic Oligonucleotide
aacaaatgggtttaat

SEQ ID NO: 3101 - DNA, 16 bp, Artificial sequence
  Synthetic Oligonucleotide
gaatatttgcaagtct

SEQ ID NO: 3102 - DNA, 16 bp, Artificial sequence
  Synthetic Oligonucleotide
tcattggtagaggaat

SEQ ID NO: 3103 - DNA, 16 bp, Artificial sequence
  Synthetic Oligonucleotide
atattttaaagtctcg

SEQ ID NO: 3104 - DNA, 16 bp, Artificial sequence
  Synthetic Oligonucleotide
gttacattattataga

SEQ ID NO: 3105 - DNA, 16 bp, Artificial sequence
  Synthetic Oligonucleotide
gtgaaatgtgttacat

SEQ ID NO: 3106 - DNA, 16 bp, Artificial sequence
  Synthetic Oligonucleotide
tcaccagtgaaatgtg

SEQ ID NO: 3107 - DNA, 16 bp, Artificial sequence
  Synthetic Oligonucleotide
catgtttcaccagtga

SEQ ID NO: 3108 - DNA, 16 bp, Artificial sequence
  Synthetic Oligonucleotide
acaagacatgtttcac

SEQ ID NO: 3109 - DNA, 16 bp, Artificial sequence
  Synthetic Oligonucleotide
catatgacaagacatg

SEQ ID NO: 3110 - DNA, 16 bp, Artificial sequence
  Synthetic Oligonucleotide
ctataatgcatatgac

SEQ ID NO: 3111 - DNA, 16 bp, Artificial sequence
  Synthetic Oligonucleotide
tcctttctataatgca

SEQ ID NO: 3112 - DNA, 16 bp, Artificial sequence
  Synthetic Oligonucleotide
tgattatcctttctat

SEQ ID NO: 3113 - DNA, 16 bp, Artificial sequence
  Synthetic Oligonucleotide
taactgaaagtctgat

SEQ ID NO: 3114 - DNA, 16 bp, Artificial sequence
  Synthetic Oligonucleotide
gtgcacaaaaatgtta

SEQ ID NO: 3115 - DNA, 16 bp, Artificial sequence
  Synthetic Oligonucleotide
agctatgtgcacaaaa

SEQ ID NO: 3116 - DNA, 16 bp, Artificial sequence
  Synthetic Oligonucleotide
gaagatagctatgtgc

SEQ ID NO: 3117 - DNA, 16 bp, Artificial sequence
  Synthetic Oligonucleotide
tttattgaagatagct

SEQ ID NO: 3118 - DNA, 16 bp, Artificial sequence
  Synthetic Oligonucleotide
tcattttagtgtatct

SEQ ID NO: 3119 - DNA, 16 bp, Artificial sequence
  Synthetic Oligonucleotide
ccttgatcattttagt

SEQ ID NO: 3120 - DNA, 16 bp, Artificial sequence
  Synthetic Oligonucleotide
tgaatcccttgatcat

SEQ ID NO: 3121 - DNA, 16 bp, Artificial sequence
  Synthetic Oligonucleotide
gttgtttagtcttgaa

SEQ ID NO: 3122 - DNA, 16 bp, Artificial sequence
  Synthetic Oligonucleotide
aattgagttgtttagt

SEQ ID NO: 3123 - DNA, 16 bp, Artificial sequence
  Synthetic Oligonucleotide
gcaactaattgagttg

SEQ ID NO: 3124 - DNA, 16 bp, Artificial sequence
  Synthetic Oligonucleotide
attggtgcaactaatt

SEQ ID NO: 3125 - DNA, 16 bp, Artificial sequence
  Synthetic Oligonucleotide
gttttttattggtgca

SEQ ID NO: 3126 - DNA, 16 bp, Artificial sequence
  Synthetic Oligonucleotide
ggacactgacagtttt

SEQ ID NO: 3127 - DNA, 16 bp, Artificial sequence
  Synthetic Oligonucleotide
caggttggacactgac

SEQ ID NO: 3128 - DNA, 16 bp, Artificial sequence
  Synthetic Oligonucleotide
taagtacaggttggac

SEQ ID NO: 3129 - DNA, 16 bp, Artificial sequence
  Synthetic Oligonucleotide
agttattaagtacagg

SEQ ID NO: 3130 - DNA, 16 bp, Artificial sequence
  Synthetic Oligonucleotide
tctgtgagttattaag

SEQ ID NO: 3131 - DNA, 16 bp, Artificial sequence
  Synthetic Oligonucleotide
accaaaattctcctga

SEQ ID NO: 3132 - DNA, 16 bp, Artificial sequence
  Synthetic Oligonucleotide
acctgaataaccctct

SEQ ID NO: 3133 - DNA, 16 bp, Artificial sequence
  Synthetic Oligonucleotide
ggtatcagaaaaagat

SEQ ID NO: 3134 - DNA, 16 bp, Artificial sequence
  Synthetic Oligonucleotide
agtattggtatcagaa

SEQ ID NO: 3135 - DNA, 16 bp, Artificial sequence
  Synthetic Oligonucleotide
ggaagatactttgaag

SEQ ID NO: 3136 - DNA, 16 bp, Artificial sequence
  Synthetic Oligonucleotide
aatgtgggaagatact

SEQ ID NO: 3137 - DNA, 16 bp, Artificial sequence
  Synthetic Oligonucleotide
cagataatagctaata

SEQ ID NO: 3138 - DNA, 16 bp, Artificial sequence
  Synthetic Oligonucleotide
tcattgcagataatag

SEQ ID NO: 3139 - DNA, 16 bp, Artificial sequence
  Synthetic Oligonucleotide
gattcggatttttaaa

SEQ ID NO: 3140 - DNA, 16 bp, Artificial sequence
  Synthetic Oligonucleotide
atttgggattcggatt

SEQ ID NO: 3141 - DNA, 16 bp, Artificial sequence
  Synthetic Oligonucleotide
acgcttatttgggatt

SEQ ID NO: 3142 - DNA, 16 bp, Artificial sequence
  Synthetic Oligonucleotide
tctagagagaaaacgc

SEQ ID NO: 3143 - DNA, 16 bp, Artificial sequence
  Synthetic Oligonucleotide
agttaagaggttttcg

SEQ ID NO: 3144 - DNA, 16 bp, Artificial sequence
  Synthetic Oligonucleotide
cattatagttaagagg

SEQ ID NO: 3145 - DNA, 16 bp, Artificial sequence
  Synthetic Oligonucleotide
cactttcattatagtt

SEQ ID NO: 3146 - DNA, 16 bp, Artificial sequence
  Synthetic Oligonucleotide
tagaatgaacactttc

SEQ ID NO: 3147 - DNA, 16 bp, Artificial sequence
  Synthetic Oligonucleotide
ttgaactagaatgaac

SEQ ID NO: 3148 - DNA, 16 bp, Artificial sequence
  Synthetic Oligonucleotide
acctgattgaactaga

SEQ ID NO: 3149 - DNA, 16 bp, Artificial sequence
  Synthetic Oligonucleotide
taaaatacctgattga

SEQ ID NO: 3150 - DNA, 16 bp, Artificial sequence
  Synthetic Oligonucleotide
tagaggtaaaatacct

SEQ ID NO: 3151 - DNA, 16 bp, Artificial sequence
  Synthetic Oligonucleotide
gaagattagaggtaaa

SEQ ID NO: 3152 - DNA, 16 bp, Artificial sequence
  Synthetic Oligonucleotide
tctgaggaagattaga

SEQ ID NO: 3153 - DNA, 16 bp, Artificial sequence
  Synthetic Oligonucleotide
tatacactaccaaaaa

SEQ ID NO: 3154 - DNA, 16 bp, Artificial sequence
  Synthetic Oligonucleotide
ataatctatacactac

SEQ ID NO: 3155 - DNA, 16 bp, Artificial sequence
  Synthetic Oligonucleotide
taagtcccaattttaa

SEQ ID NO: 3156 - DNA, 16 bp, Artificial sequence
  Synthetic Oligonucleotide
ccagttttaaataatc

SEQ ID NO: 3157 - DNA, 16 bp, Artificial sequence
  Synthetic Oligonucleotide
tgtatcccagttttaa

SEQ ID NO: 3158 - DNA, 16 bp, Artificial sequence
  Synthetic Oligonucleotide
gttttagatgcatgta

SEQ ID NO: 3159 - DNA, 16 bp, Artificial sequence
  Synthetic Oligonucleotide
tacagtgttttagatg

SEQ ID NO: 3160 - DNA, 16 bp, Artificial sequence
  Synthetic Oligonucleotide
ttccccgtaagtttat

SEQ ID NO: 3161 - DNA, 16 bp, Artificial sequence
  Synthetic Oligonucleotide
ctgtatttccccgtaa

SEQ ID NO: 3162 - DNA, 16 bp, Artificial sequence
  Synthetic Oligonucleotide
tagttactgttactgt

SEQ ID NO: 3163 - DNA, 16 bp, Artificial sequence
  Synthetic Oligonucleotide
cgtatgtagttactgt

SEQ ID NO: 3164 - DNA, 16 bp, Artificial sequence
  Synthetic Oligonucleotide
aatgggtacagactcg

SEQ ID NO: 3165 - DNA, 16 bp, Artificial sequence
  Synthetic Oligonucleotide
gcaatttaatgggtac

SEQ ID NO: 3166 - DNA, 16 bp, Artificial sequence
  Synthetic Oligonucleotide
gatagatatgcaattt

SEQ ID NO: 3167 - DNA, 16 bp, Artificial sequence
  Synthetic Oligonucleotide
aaaggagatagatatg

SEQ ID NO: 3168 - DNA, 16 bp, Artificial sequence
  Synthetic Oligonucleotide
cctcctaaaggagata

SEQ ID NO: 3169 - DNA, 16 bp, Artificial sequence
  Synthetic Oligonucleotide
caccagcctcctaaag

SEQ ID NO: 3170 - DNA, 16 bp, Artificial sequence
  Synthetic Oligonucleotide
tttgtgatcccaagta

SEQ ID NO: 3171 - DNA, 16 bp, Artificial sequence
  Synthetic Oligonucleotide
gctttgtgatcccaag

SEQ ID NO: 3172 - DNA, 16 bp, Artificial sequence
  Synthetic Oligonucleotide
ttgctttgtgatccca

SEQ ID NO: 3173 - DNA, 16 bp, Artificial sequence
  Synthetic Oligonucleotide
ttttgctttgtgatcc

SEQ ID NO: 3174 - DNA, 16 bp, Artificial sequence
  Synthetic Oligonucleotide
ccttttgctttgtgat

SEQ ID NO: 3175 - DNA, 16 bp, Artificial sequence
  Synthetic Oligonucleotide
gtccttttgctttgtg

SEQ ID NO: 3176 - DNA, 16 bp, Artificial sequence
  Synthetic Oligonucleotide
gtgtccttttgctttg

SEQ ID NO: 3177 - DNA, 16 bp, Artificial sequence
  Synthetic Oligonucleotide
gaaatgtaaacggtat

SEQ ID NO: 3178 - DNA, 16 bp, Artificial sequence
  Synthetic Oligonucleotide
ttgagaaatgtaaacg

SEQ ID NO: 3179 - DNA, 16 bp, Artificial sequence
  Synthetic Oligonucleotide
tgattgagaaatgtaa

SEQ ID NO: 3180 - DNA, 16 bp, Artificial sequence
  Synthetic Oligonucleotide
tttgattgagaaatgt

SEQ ID NO: 3181 - DNA, 16 bp, Artificial sequence
  Synthetic Oligonucleotide
aagaattttgattgag

SEQ ID NO: 3182 - DNA, 16 bp, Artificial sequence
  Synthetic Oligonucleotide
ataagaattttgattg

SEQ ID NO: 3183 - DNA, 16 bp, Artificial sequence
  Synthetic Oligonucleotide
caaatagtattataag

SEQ ID NO: 3184 - DNA, 16 bp, Artificial sequence
  Synthetic Oligonucleotide
cccacatcacaaaatt

SEQ ID NO: 3185 - DNA, 16 bp, Artificial sequence
  Synthetic Oligonucleotide
gattcccacatcacaa

SEQ ID NO: 3186 - DNA, 16 bp, Artificial sequence
  Synthetic Oligonucleotide
ttgattcccacatcac

SEQ ID NO: 3187 - DNA, 16 bp, Artificial sequence
  Synthetic Oligonucleotide
aattgattcccacatc

SEQ ID NO: 3188 - DNA, 16 bp, Artificial sequence
  Synthetic Oligonucleotide
aaaattgattcccaca

SEQ ID NO: 3189 - DNA, 16 bp, Artificial sequence
  Synthetic Oligonucleotide
ctaaaattgattccca

SEQ ID NO: 3190 - DNA, 16 bp, Artificial sequence
  Synthetic Oligonucleotide
catctaaaattgattc

SEQ ID NO: 3191 - DNA, 16 bp, Artificial sequence
  Synthetic Oligonucleotide
accatctaaaattgat

SEQ ID NO: 3192 - DNA, 16 bp, Artificial sequence
  Synthetic Oligonucleotide
tgaccatctaaaattg

SEQ ID NO: 3193 - DNA, 16 bp, Artificial sequence
  Synthetic Oligonucleotide
tgtgaccatctaaaat

SEQ ID NO: 3194 - DNA, 16 bp, Artificial sequence
  Synthetic Oligonucleotide
attgtgaccatctaaa

SEQ ID NO: 3195 - DNA, 16 bp, Artificial sequence
  Synthetic Oligonucleotide
agattgtgaccatcta

SEQ ID NO: 3196 - DNA, 16 bp, Artificial sequence
  Synthetic Oligonucleotide
ctagattgtgaccatc

SEQ ID NO: 3197 - DNA, 16 bp, Artificial sequence
  Synthetic Oligonucleotide
atctagattgtgacca

SEQ ID NO: 3198 - DNA, 16 bp, Artificial sequence
  Synthetic Oligonucleotide
taatctagattgtgac

SEQ ID NO: 3199 - DNA, 16 bp, Artificial sequence
  Synthetic Oligonucleotide
tataatctagattgtg

SEQ ID NO: 3200 - DNA, 16 bp, Artificial sequence
  Synthetic Oligonucleotide
attataatctagattg

SEQ ID NO: 3201 - DNA, 16 bp, Artificial sequence
  Synthetic Oligonucleotide
tgattataatctagat

SEQ ID NO: 3202 - DNA, 16 bp, Artificial sequence
  Synthetic Oligonucleotide
attgattataatctag

SEQ ID NO: 3203 - DNA, 16 bp, Artificial sequence
  Synthetic Oligonucleotide
ctattgattataatct

SEQ ID NO: 3204 - DNA, 16 bp, Artificial sequence
  Synthetic Oligonucleotide
acctattgattataat

SEQ ID NO: 3205 - DNA, 16 bp, Artificial sequence
  Synthetic Oligonucleotide
tcacctattgattata

SEQ ID NO: 3206 - DNA, 16 bp, Artificial sequence
  Synthetic Oligonucleotide
gttcacctattgatta

SEQ ID NO: 3207 - DNA, 16 bp, Artificial sequence
  Synthetic Oligonucleotide
aagttcacctattgat

SEQ ID NO: 3208 - DNA, 16 bp, Artificial sequence
  Synthetic Oligonucleotide
ataagttcacctattg

SEQ ID NO: 3209 - DNA, 16 bp, Artificial sequence
  Synthetic Oligonucleotide
taataagttcacctat

SEQ ID NO: 3210 - DNA, 16 bp, Artificial sequence
  Synthetic Oligonucleotide
tttaataagttcacct

SEQ ID NO: 3211 - DNA, 16 bp, Artificial sequence
  Synthetic Oligonucleotide
tatttaataagttcac

SEQ ID NO: 3212 - DNA, 16 bp, Artificial sequence
  Synthetic Oligonucleotide
gttatttaataagttc

SEQ ID NO: 3213 - DNA, 16 bp, Artificial sequence
  Synthetic Oligonucleotide
catatgatgcctttta

SEQ ID NO: 3214 - DNA, 16 bp, Artificial sequence
  Synthetic Oligonucleotide
tattagctcatatgat

SEQ ID NO: 3215 - DNA, 16 bp, Artificial sequence
  Synthetic Oligonucleotide
gatattagctcatatg

SEQ ID NO: 3216 - DNA, 16 bp, Artificial sequence
  Synthetic Oligonucleotide
gtgatattagctcata

SEQ ID NO: 3217 - DNA, 16 bp, Artificial sequence
  Synthetic Oligonucleotide
agttgtgatattagct

SEQ ID NO: 3218 - DNA, 16 bp, Artificial sequence
  Synthetic Oligonucleotide
aaagttgtgatattag

SEQ ID NO: 3219 - DNA, 16 bp, Artificial sequence
  Synthetic Oligonucleotide
ggaaagttgtgatatt

SEQ ID NO: 3220 - DNA, 16 bp, Artificial sequence
  Synthetic Oligonucleotide
tgggaaagttgtgata

SEQ ID NO: 3221 - DNA, 16 bp, Artificial sequence
  Synthetic Oligonucleotide
aaactgggaaagttgt

SEQ ID NO: 3222 - DNA, 16 bp, Artificial sequence
  Synthetic Oligonucleotide
ttaaactgggaaagtt

SEQ ID NO: 3223 - DNA, 16 bp, Artificial sequence
  Synthetic Oligonucleotide
gttttttaaactggga

SEQ ID NO: 3224 - DNA, 16 bp, Artificial sequence
  Synthetic Oligonucleotide
tagttttttaaactgg

SEQ ID NO: 3225 - DNA, 16 bp, Artificial sequence
  Synthetic Oligonucleotide
gagtactagtttttta

SEQ ID NO: 3226 - DNA, 16 bp, Artificial sequence
  Synthetic Oligonucleotide
aagagtactagttttt

SEQ ID NO: 3227 - DNA, 16 bp, Artificial sequence
  Synthetic Oligonucleotide
acaagagtactagttt

SEQ ID NO: 3228 - DNA, 16 bp, Artificial sequence
  Synthetic Oligonucleotide
taacaagagtactagt

SEQ ID NO: 3229 - DNA, 16 bp, Artificial sequence
  Synthetic Oligonucleotide
tttaacaagagtacta

SEQ ID NO: 3230 - DNA, 16 bp, Artificial sequence
  Synthetic Oligonucleotide
gttttaacaagagtac

SEQ ID NO: 3231 - DNA, 16 bp, Artificial sequence
  Synthetic Oligonucleotide
gagttttaacaagagt

SEQ ID NO: 3232 - DNA, 16 bp, Artificial sequence
  Synthetic Oligonucleotide
tagagttttaacaaga

SEQ ID NO: 3233 - DNA, 16 bp, Artificial sequence
  Synthetic Oligonucleotide
gtttagagttttaaca

SEQ ID NO: 3234 - DNA, 16 bp, Artificial sequence
  Synthetic Oligonucleotide
caagtttagagtttta

SEQ ID NO: 3235 - DNA, 16 bp, Artificial sequence
  Synthetic Oligonucleotide
gtcaagtttagagttt

SEQ ID NO: 3236 - DNA, 16 bp, Artificial sequence
  Synthetic Oligonucleotide
tagtcaagtttagagt

SEQ ID NO: 3237 - DNA, 16 bp, Artificial sequence
  Synthetic Oligonucleotide
tttagtcaagtttaga

SEQ ID NO: 3238 - DNA, 16 bp, Artificial sequence
  Synthetic Oligonucleotide
tatttagtcaagttta

SEQ ID NO: 3239 - DNA, 16 bp, Artificial sequence
  Synthetic Oligonucleotide
tgtatttagtcaagtt

SEQ ID NO: 3240 - DNA, 16 bp, Artificial sequence
  Synthetic Oligonucleotide
tctgtatttagtcaag

SEQ ID NO: 3241 - DNA, 16 bp, Artificial sequence
  Synthetic Oligonucleotide
cctctgtatttagtca

SEQ ID NO: 3242 - DNA, 16 bp, Artificial sequence
  Synthetic Oligonucleotide
gtcctctgtatttagt

SEQ ID NO: 3243 - DNA, 16 bp, Artificial sequence
  Synthetic Oligonucleotide
cagtcctctgtattta

SEQ ID NO: 3244 - DNA, 16 bp, Artificial sequence
  Synthetic Oligonucleotide
accagtcctctgtatt

SEQ ID NO: 3245 - DNA, 16 bp, Artificial sequence
  Synthetic Oligonucleotide
ttaccagtcctctgta

SEQ ID NO: 3246 - DNA, 16 bp, Artificial sequence
  Synthetic Oligonucleotide
aattaccagtcctctg

SEQ ID NO: 3247 - DNA, 16 bp, Artificial sequence
  Synthetic Oligonucleotide
acaattaccagtcctc

SEQ ID NO: 3248 - DNA, 16 bp, Artificial sequence
  Synthetic Oligonucleotide
tctgacaagattcctt

SEQ ID NO: 3249 - DNA, 16 bp, Artificial sequence
  Synthetic Oligonucleotide
atctgacaagattcct

SEQ ID NO: 3250 - DNA, 16 bp, Artificial sequence
  Synthetic Oligonucleotide
taatctgacaagattc

SEQ ID NO: 3251 - DNA, 16 bp, Artificial sequence
  Synthetic Oligonucleotide
gtaatctgacaagatt

SEQ ID NO: 3252 - DNA, 16 bp, Artificial sequence
  Synthetic Oligonucleotide
cttgtcaggctgttta

SEQ ID NO: 3253 - DNA, 16 bp, Artificial sequence
  Synthetic Oligonucleotide
gcttgtcaggctgttt

SEQ ID NO: 3254 - DNA, 16 bp, Artificial sequence
  Synthetic Oligonucleotide
atgcttgtcaggctgt

SEQ ID NO: 3255 - DNA, 16 bp, Artificial sequence
  Synthetic Oligonucleotide
tacatgcttgtcaggc

SEQ ID NO: 3256 - DNA, 16 bp, Artificial sequence
  Synthetic Oligonucleotide
atacatgcttgtcagg

SEQ ID NO: 3257 - DNA, 16 bp, Artificial sequence
  Synthetic Oligonucleotide
aaaggtaggtcaccat

SEQ ID NO: 3258 - DNA, 16 bp, Artificial sequence
  Synthetic Oligonucleotide
caaaggtaggtcacca

SEQ ID NO: 3259 - DNA, 16 bp, Artificial sequence
  Synthetic Oligonucleotide
gacaaaggtaggtcac

SEQ ID NO: 3260 - DNA, 16 bp, Artificial sequence
  Synthetic Oligonucleotide
tgacaaaggtaggtca

SEQ ID NO: 3261 - DNA, 16 bp, Artificial sequence
  Synthetic Oligonucleotide
tctgacatagcttttt

SEQ ID NO: 3262 - DNA, 16 bp, Artificial sequence
  Synthetic Oligonucleotide
attctgacatagcttt

SEQ ID NO: 3263 - DNA, 16 bp, Artificial sequence
  Synthetic Oligonucleotide
gattctgacatagctt

SEQ ID NO: 3264 - DNA, 16 bp, Artificial sequence
  Synthetic Oligonucleotide
ggattctgacatagct

SEQ ID NO: 3265 - DNA, 16 bp, Artificial sequence
  Synthetic Oligonucleotide
atggattctgacatag

SEQ ID NO: 3266 - DNA, 16 bp, Artificial sequence
  Synthetic Oligonucleotide
catggattctgacata

SEQ ID NO: 3267 - DNA, 16 bp, Artificial sequence
  Synthetic Oligonucleotide
acatggattctgacat

SEQ ID NO: 3268 - DNA, 16 bp, Artificial sequence
  Synthetic Oligonucleotide
tacatggattctgaca

SEQ ID NO: 3269 - DNA, 16 bp, Artificial sequence
  Synthetic Oligonucleotide
atacatggattctgac

SEQ ID NO: 3270 - DNA, 16 bp, Artificial sequence
  Synthetic Oligonucleotide
tttagcagcactacta

SEQ ID NO: 3271 - DNA, 16 bp, Artificial sequence
  Synthetic Oligonucleotide
ttttagcagcactact

SEQ ID NO: 3272 - DNA, 16 bp, Artificial sequence
  Synthetic Oligonucleotide
cttttagcagcactac

SEQ ID NO: 3273 - DNA, 16 bp, Artificial sequence
  Synthetic Oligonucleotide
aaaaccttttagcagc

SEQ ID NO: 3274 - DNA, 16 bp, Artificial sequence
  Synthetic Oligonucleotide
gataaaaaacctttta

SEQ ID NO: 3275 - DNA, 16 bp, Artificial sequence
  Synthetic Oligonucleotide
tgataaaaaacctttt

SEQ ID NO: 3276 - DNA, 16 bp, Artificial sequence
  Synthetic Oligonucleotide
agatgttggcaggttg

SEQ ID NO: 3277 - DNA, 16 bp, Artificial sequence
  Synthetic Oligonucleotide
tagatgttggcaggtt

SEQ ID NO: 3278 - DNA, 16 bp, Artificial sequence
  Synthetic Oligonucleotide
gtagatgttggcaggt

SEQ ID NO: 3279 - DNA, 16 bp, Artificial sequence
  Synthetic Oligonucleotide
tgtagatgttggcagg

SEQ ID NO: 3280 - DNA, 16 bp, Artificial sequence
  Synthetic Oligonucleotide
ctgtagatgttggcag

SEQ ID NO: 3281 - DNA, 16 bp, Artificial sequence
  Synthetic Oligonucleotide
tatctgtagatgttgg

SEQ ID NO: 3282 - DNA, 16 bp, Artificial sequence
  Synthetic Oligonucleotide
atatctgtagatgttg

SEQ ID NO: 3283 - DNA, 16 bp, Artificial sequence
  Synthetic Oligonucleotide
catatctgtagatgtt

SEQ ID NO: 3284 - DNA, 16 bp, Artificial sequence
  Synthetic Oligonucleotide
tttgaaccaggctttc

SEQ ID NO: 3285 - DNA, 16 bp, Artificial sequence
  Synthetic Oligonucleotide
aatttgaaccaggctt

SEQ ID NO: 3286 - DNA, 16 bp, Artificial sequence
  Synthetic Oligonucleotide
cataatttgaaccagg

SEQ ID NO: 3287 - DNA, 16 bp, Artificial sequence
  Synthetic Oligonucleotide
acataatttgaaccag

SEQ ID NO: 3288 - DNA, 16 bp, Artificial sequence
  Synthetic Oligonucleotide
tacataatttgaacca

SEQ ID NO: 3289 - DNA, 16 bp, Artificial sequence
  Synthetic Oligonucleotide
atacataatttgaacc

SEQ ID NO: 3290 - DNA, 16 bp, Artificial sequence
  Synthetic Oligonucleotide
acattggtcggaaaac

SEQ ID NO: 3291 - DNA, 16 bp, Artificial sequence
  Synthetic Oligonucleotide
gacattggtcggaaaa

SEQ ID NO: 3292 - DNA, 16 bp, Artificial sequence
  Synthetic Oligonucleotide
agacattggtcggaaa

SEQ ID NO: 3293 - DNA, 16 bp, Artificial sequence
  Synthetic Oligonucleotide
cagacattggtcggaa

SEQ ID NO: 3294 - DNA, 16 bp, Artificial sequence
  Synthetic Oligonucleotide
gcagacattggtcgga

SEQ ID NO: 3295 - DNA, 16 bp, Artificial sequence
  Synthetic Oligonucleotide
aagcagacattggtcg

SEQ ID NO: 3296 - DNA, 16 bp, Artificial sequence
  Synthetic Oligonucleotide
tgtacagattacctgt

SEQ ID NO: 3297 - DNA, 16 bp, Artificial sequence
  Synthetic Oligonucleotide
ttgtacagattacctg

SEQ ID NO: 3298 - DNA, 16 bp, Artificial sequence
  Synthetic Oligonucleotide
attgtacagattacct

SEQ ID NO: 3299 - DNA, 16 bp, Artificial sequence
  Synthetic Oligonucleotide
gattgtacagattacc

SEQ ID NO: 3300 - DNA, 16 bp, Artificial sequence
  Synthetic Oligonucleotide
agattgtacagattac

SEQ ID NO: 3301 - DNA, 16 bp, Artificial sequence
  Synthetic Oligonucleotide
tcagattgtacagatt

SEQ ID NO: 3302 - DNA, 16 bp, Artificial sequence
  Synthetic Oligonucleotide
ttcagattgtacagat

SEQ ID NO: 3303 - DNA, 16 bp, Artificial sequence
  Synthetic Oligonucleotide
attcagattgtacaga

SEQ ID NO: 3304 - DNA, 16 bp, Artificial sequence
  Synthetic Oligonucleotide
tattcagattgtacag

SEQ ID NO: 3305 - DNA, 16 bp, Artificial sequence
  Synthetic Oligonucleotide
ttattcagattgtaca

SEQ ID NO: 3306 - DNA, 16 bp, Artificial sequence
  Synthetic Oligonucleotide
taggtatgtcttttat

SEQ ID NO: 3307 - DNA, 16 bp, Artificial sequence
  Synthetic Oligonucleotide
tgtcttaggtatgtct

SEQ ID NO: 3308 - DNA, 16 bp, Artificial sequence
  Synthetic Oligonucleotide
attgtcttaggtatgt

SEQ ID NO: 3309 - DNA, 16 bp, Artificial sequence
  Synthetic Oligonucleotide
gattgtcttaggtatg

SEQ ID NO: 3310 - DNA, 16 bp, Artificial sequence
  Synthetic Oligonucleotide
ttcttagatggcgtgt

SEQ ID NO: 3311 - DNA, 16 bp, Artificial sequence
  Synthetic Oligonucleotide
atttttcttagatggc

SEQ ID NO: 3312 - DNA, 16 bp, Artificial sequence
  Synthetic Oligonucleotide
catttttcttagatgg

SEQ ID NO: 3313 - DNA, 16 bp, Artificial sequence
  Synthetic Oligonucleotide
gcatttttcttagatg

SEQ ID NO: 3314 - DNA, 16 bp, Artificial sequence
  Synthetic Oligonucleotide
ataagtcccaatttta

SEQ ID NO: 3315 - DNA, 16 bp, Artificial sequence
  Synthetic Oligonucleotide
tataagtcccaatttt

SEQ ID NO: 3316 - DNA, 16 bp, Artificial sequence
  Synthetic Oligonucleotide
gtataagtcccaattt

SEQ ID NO: 3317 - DNA, 16 bp, Artificial sequence
  Synthetic Oligonucleotide
tgtataagtcccaatt

SEQ ID NO: 3318 - DNA, 16 bp, Artificial sequence
  Synthetic Oligonucleotide
ctgtataagtcccaat

SEQ ID NO: 3319 - DNA, 16 bp, Artificial sequence
  Synthetic Oligonucleotide
taatctgtataagtcc

SEQ ID NO: 3320 - DNA, 16 bp, Artificial sequence
  Synthetic Oligonucleotide
ataatctgtataagtc

SEQ ID NO: 3321 - DNA, 16 bp, Artificial sequence
  Synthetic Oligonucleotide
aataatctgtataagt

SEQ ID NO: 3322 - DNA, 16 bp, Artificial sequence
  Synthetic Oligonucleotide
tgcatgtatcccagtt

SEQ ID NO: 3323 - DNA, 16 bp, Artificial sequence
  Synthetic Oligonucleotide
tagatgcatgtatccc

SEQ ID NO: 3324 - DNA, 16 bp, Artificial sequence
  Synthetic Oligonucleotide
ttagatgcatgtatcc

SEQ ID NO: 3325 - DNA, 16 bp, Artificial sequence
  Synthetic Oligonucleotide
tttagatgcatgtatc

SEQ ID NO: 3326 - DNA, 16 bp, Artificial sequence
  Synthetic Oligonucleotide
gtggaactgttttctt

SEQ ID NO: 3327 - DNA, 16 bp, Artificial sequence
  Synthetic Oligonucleotide
acgtggaactgttttc

SEQ ID NO: 3328 - DNA, 16 bp, Artificial sequence
  Synthetic Oligonucleotide
ttgatcaattctggag

SEQ ID NO: 3329 - DNA, 16 bp, Artificial sequence
  Synthetic Oligonucleotide
tcttgatcaattctgg

SEQ ID NO: 3330 - DNA, 16 bp, Artificial sequence
  Synthetic Oligonucleotide
ggctctggagatagag

SEQ ID NO: 3331 - DNA, 16 bp, Artificial sequence
  Synthetic Oligonucleotide
ttggctctggagatag

SEQ ID NO: 3332 - DNA, 16 bp, Artificial sequence
  Synthetic Oligonucleotide
gattttggctctggag

SEQ ID NO: 3333 - DNA, 16 bp, Artificial sequence
  Synthetic Oligonucleotide
tcttgattttggctct

SEQ ID NO: 3334 - DNA, 16 bp, Artificial sequence
  Synthetic Oligonucleotide
aatcttgattttggct

SEQ ID NO: 3335 - DNA, 16 bp, Artificial sequence
  Synthetic Oligonucleotide
caaatcttgattttgg

SEQ ID NO: 3336 - DNA, 16 bp, Artificial sequence
  Synthetic Oligonucleotide
gcagcgatagatcata

SEQ ID NO: 3337 - DNA, 16 bp, Artificial sequence
  Synthetic Oligonucleotide
ttgcagcgatagatca

SEQ ID NO: 3338 - DNA, 16 bp, Artificial sequence
  Synthetic Oligonucleotide
tggtttgcagcgatag

SEQ ID NO: 3339 - DNA, 16 bp, Artificial sequence
  Synthetic Oligonucleotide
tttgatttcactggtt

SEQ ID NO: 3340 - DNA, 16 bp, Artificial sequence
  Synthetic Oligonucleotide
tctttgatttcactgg

SEQ ID NO: 3341 - DNA, 16 bp, Artificial sequence
  Synthetic Oligonucleotide
agttcttctcagttcc

SEQ ID NO: 3342 - DNA, 16 bp, Artificial sequence
  Synthetic Oligonucleotide
ttagttagttgctctt

SEQ ID NO: 3343 - DNA, 16 bp, Artificial sequence
  Synthetic Oligonucleotide
agttagttagttgctc

SEQ ID NO: 3344 - DNA, 16 bp, Artificial sequence
  Synthetic Oligonucleotide
gtgctcttggcttgga

SEQ ID NO: 3345 - DNA, 16 bp, Artificial sequence
  Synthetic Oligonucleotide
tggtgctcttggcttg

SEQ ID NO: 3346 - DNA, 16 bp, Artificial sequence
  Synthetic Oligonucleotide
tatgttcacctctgtt

SEQ ID NO: 3347 - DNA, 16 bp, Artificial sequence
  Synthetic Oligonucleotide
tgtatgttcacctctg

SEQ ID NO: 3348 - DNA, 16 bp, Artificial sequence
  Synthetic Oligonucleotide
acactcatcatgccac

SEQ ID NO: 3349 - DNA, 16 bp, Artificial sequence
  Synthetic Oligonucleotide
ccacactcatcatgcc

SEQ ID NO: 3350 - DNA, 16 bp, Artificial sequence
  Synthetic Oligonucleotide
ttagattttgctcttg

SEQ ID NO: 3351 - DNA, 16 bp, Artificial sequence
  Synthetic Oligonucleotide
atagagtataaccttc

SEQ ID NO: 3352 - DNA, 16 bp, Artificial sequence
  Synthetic Oligonucleotide
aatctgttggatggat

SEQ ID NO: 3353 - DNA, 16 bp, Artificial sequence
  Synthetic Oligonucleotide
tgaatctgttggatgg

SEQ ID NO: 3354 - DNA, 16 bp, Artificial sequence
  Synthetic Oligonucleotide
ttcattcaaagctttc

SEQ ID NO: 3355 - DNA, 16 bp, Artificial sequence
  Synthetic Oligonucleotide
agttcattcaaagctt

SEQ ID NO: 3356 - DNA, 16 bp, Artificial sequence
  Synthetic Oligonucleotide
tcagttcattcaaagc

SEQ ID NO: 3357 - DNA, 16 bp, Artificial sequence
  Synthetic Oligonucleotide
gattattagaccacat

SEQ ID NO: 3358 - DNA, 16 bp, Artificial sequence
  Synthetic Oligonucleotide
aatagacagtgacttt

SEQ ID NO: 3359 - DNA, 16 bp, Artificial sequence
  Synthetic Oligonucleotide
agaaatgtaaacggta

SEQ ID NO: 3360 - DNA, 16 bp, Artificial sequence
  Synthetic Oligonucleotide
tcatatgatgcctttt

SEQ ID NO: 3361 - DNA, 16 bp, Artificial sequence
  Synthetic Oligonucleotide
attagctcatatgatg

SEQ ID NO: 3362 - DNA, 16 bp, Artificial sequence
  Synthetic Oligonucleotide
tgtgatattagctcat

SEQ ID NO: 3363 - DNA, 16 bp, Artificial sequence
  Synthetic Oligonucleotide
gttgtgatattagctc

SEQ ID NO: 3364 - DNA, 16 bp, Artificial sequence
  Synthetic Oligonucleotide
tactctgtgctgacga

SEQ ID NO: 3365 - DNA, 16 bp, Artificial sequence
  Synthetic Oligonucleotide
catactctgtgctgac

SEQ ID NO: 3366 - DNA, 16 bp, Artificial sequence
  Synthetic Oligonucleotide
gtttaaagacagcgaa

SEQ ID NO: 3367 - DNA, 16 bp, Artificial sequence
  Synthetic Oligonucleotide
ttgtttaaagacagcg

SEQ ID NO: 3368 - DNA, 16 bp, Artificial sequence
  Synthetic Oligonucleotide
gtagtcatctccattt

SEQ ID NO: 3369 - DNA, 16 bp, Artificial sequence
  Synthetic Oligonucleotide
tagtagtcatctccat

SEQ ID NO: 3370 - DNA, 16 bp, Artificial sequence
  Synthetic Oligonucleotide
tcttaactctatatat

SEQ ID NO: 3371 - DNA, 16 bp, Artificial sequence
  Synthetic Oligonucleotide
cttcttaactctatat

SEQ ID NO: 3372 - DNA, 16 bp, Artificial sequence
  Synthetic Oligonucleotide
gacttcttaactctat

SEQ ID NO: 3373 - DNA, 16 bp, Artificial sequence
  Synthetic Oligonucleotide
tagacttcttaactct

SEQ ID NO: 3374 - DNA, 16 bp, Artificial sequence
  Synthetic Oligonucleotide
cctagacttcttaact

SEQ ID NO: 3375 - DNA, 16 bp, Artificial sequence
  Synthetic Oligonucleotide
gacctagacttcttaa

SEQ ID NO: 3376 - DNA, 16 bp, Artificial sequence
  Synthetic Oligonucleotide
cagacctagacttctt

SEQ ID NO: 3377 - DNA, 16 bp, Artificial sequence
  Synthetic Oligonucleotide
agcagacctagacttc

SEQ ID NO: 3378 - DNA, 16 bp, Artificial sequence
  Synthetic Oligonucleotide
gaagcagacctagact

SEQ ID NO: 3379 - DNA, 16 bp, Artificial sequence
  Synthetic Oligonucleotide
tggaagcagacctaga

SEQ ID NO: 3380 - DNA, 16 bp, Artificial sequence
  Synthetic Oligonucleotide
ctttaacaaatgggtt

SEQ ID NO: 3381 - DNA, 16 bp, Artificial sequence
  Synthetic Oligonucleotide
atcctttaacaaatgg

SEQ ID NO: 3382 - DNA, 16 bp, Artificial sequence
  Synthetic Oligonucleotide
ctatatcctttaacaa

SEQ ID NO: 3383 - DNA, 16 bp, Artificial sequence
  Synthetic Oligonucleotide
gcactatatcctttaa

SEQ ID NO: 3384 - DNA, 16 bp, Artificial sequence
  Synthetic Oligonucleotide
tgggcactatatcctt

SEQ ID NO: 3385 - DNA, 16 bp, Artificial sequence
  Synthetic Oligonucleotide
acttgggcactatatc

SEQ ID NO: 3386 - DNA, 16 bp, Artificial sequence
  Synthetic Oligonucleotide
ataacttgggcactat

SEQ ID NO: 3387 - DNA, 16 bp, Artificial sequence
  Synthetic Oligonucleotide
catataacttgggcac

SEQ ID NO: 3388 - DNA, 16 bp, Artificial sequence
  Synthetic Oligonucleotide
caccatataacttggg

SEQ ID NO: 3389 - DNA, 16 bp, Artificial sequence
  Synthetic Oligonucleotide
ggtcaccatataactt

SEQ ID NO: 3390 - DNA, 16 bp, Artificial sequence
  Synthetic Oligonucleotide
gtaggtcaccatataa

SEQ ID NO: 3391 - DNA, 16 bp, Artificial sequence
  Synthetic Oligonucleotide
aaggtaggtcaccata

SEQ ID NO: 3392 - DNA, 16 bp, Artificial sequence
  Synthetic Oligonucleotide
ttgacaaaggtaggtc

SEQ ID NO: 3393 - DNA, 16 bp, Artificial sequence
  Synthetic Oligonucleotide
gtattgacaaaggtag

SEQ ID NO: 3394 - DNA, 16 bp, Artificial sequence
  Synthetic Oligonucleotide
taagtattgacaaagg

SEQ ID NO: 3395 - DNA, 16 bp, Artificial sequence
  Synthetic Oligonucleotide
tgctaagtattgacaa

SEQ ID NO: 3396 - DNA, 16 bp, Artificial sequence
  Synthetic Oligonucleotide
taatgctaagtattga

SEQ ID NO: 3397 - DNA, 16 bp, Artificial sequence
  Synthetic Oligonucleotide
tacataatgctaagta

SEQ ID NO: 3398 - DNA, 16 bp, Artificial sequence
  Synthetic Oligonucleotide
ggataatttgaaatac

SEQ ID NO: 3399 - DNA, 16 bp, Artificial sequence
  Synthetic Oligonucleotide
tattggataatttgaa

SEQ ID NO: 3400 - DNA, 16 bp, Artificial sequence
  Synthetic Oligonucleotide
gtatattggataattt

SEQ ID NO: 3401 - DNA, 16 bp, Artificial sequence
  Synthetic Oligonucleotide
catgtatattggataa

SEQ ID NO: 3402 - DNA, 16 bp, Artificial sequence
  Synthetic Oligonucleotide
cttttatatatgtgac

SEQ ID NO: 3403 - DNA, 16 bp, Artificial sequence
  Synthetic Oligonucleotide
gatcatacatatcttt

SEQ ID NO: 3404 - DNA, 16 bp, Artificial sequence
  Synthetic Oligonucleotide
atagatcatacatatc

SEQ ID NO: 3405 - DNA, 16 bp, Artificial sequence
  Synthetic Oligonucleotide
cacatagatcatacat

SEQ ID NO: 3406 - DNA, 16 bp, Artificial sequence
  Synthetic Oligonucleotide
attcacatagatcata

SEQ ID NO: 3407 - DNA, 16 bp, Artificial sequence
  Synthetic Oligonucleotide
aggattcacatagatc

SEQ ID NO: 3408 - DNA, 16 bp, Artificial sequence
  Synthetic Oligonucleotide
cttaggattcacatag

SEQ ID NO: 3409 - DNA, 16 bp, Artificial sequence
  Synthetic Oligonucleotide
ttacttaggattcaca

SEQ ID NO: 3410 - DNA, 16 bp, Artificial sequence
  Synthetic Oligonucleotide
tatttacttaggattc

SEQ ID NO: 3411 - DNA, 16 bp, Artificial sequence
  Synthetic Oligonucleotide
cctgaaaattatagat

SEQ ID NO: 3412 - DNA, 16 bp, Artificial sequence
  Synthetic Oligonucleotide
ggtcctgaaaattata

SEQ ID NO: 3413 - DNA, 16 bp, Artificial sequence
  Synthetic Oligonucleotide
tgtggtcctgaaaatt

SEQ ID NO: 3414 - DNA, 16 bp, Artificial sequence
  Synthetic Oligonucleotide
gtctgtggtcctgaaa

SEQ ID NO: 3415 - DNA, 16 bp, Artificial sequence
  Synthetic Oligonucleotide
ttagtctgtggtcctg

SEQ ID NO: 3416 - DNA, 16 bp, Artificial sequence
  Synthetic Oligonucleotide
agcttagtctgtggtc

SEQ ID NO: 3417 - DNA, 16 bp, Artificial sequence
  Synthetic Oligonucleotide
gacagcttagtctgtg

SEQ ID NO: 3418 - DNA, 16 bp, Artificial sequence
  Synthetic Oligonucleotide
ttcgacagcttagtct

SEQ ID NO: 3419 - DNA, 16 bp, Artificial sequence
  Synthetic Oligonucleotide
aatttcgacagcttag

SEQ ID NO: 3420 - DNA, 16 bp, Artificial sequence
  Synthetic Oligonucleotide
gttaatttcgacagct

SEQ ID NO: 3421 - DNA, 16 bp, Artificial sequence
  Synthetic Oligonucleotide
cctaaaaaaatcagcg

SEQ ID NO: 3422 - DNA, 16 bp, Artificial sequence
  Synthetic Oligonucleotide
ggccctaaaaaaatca

SEQ ID NO: 3423 - DNA, 16 bp, Artificial sequence
  Synthetic Oligonucleotide
ttctggccctaaaaaa

SEQ ID NO: 3424 - DNA, 16 bp, Artificial sequence
  Synthetic Oligonucleotide
gtattctggccctaaa

SEQ ID NO: 3425 - DNA, 16 bp, Artificial sequence
  Synthetic Oligonucleotide
ttggtattctggccct

SEQ ID NO: 3426 - DNA, 16 bp, Artificial sequence
  Synthetic Oligonucleotide
attttggtattctggc

SEQ ID NO: 3427 - DNA, 16 bp, Artificial sequence
  Synthetic Oligonucleotide
gccattttggtattct

SEQ ID NO: 3428 - DNA, 16 bp, Artificial sequence
  Synthetic Oligonucleotide
ggagccattttggtat

SEQ ID NO: 3429 - DNA, 16 bp, Artificial sequence
  Synthetic Oligonucleotide
agaggagccattttgg

SEQ ID NO: 3430 - DNA, 16 bp, Artificial sequence
  Synthetic Oligonucleotide
aagagaggagccattt

SEQ ID NO: 3431 - DNA, 16 bp, Artificial sequence
  Synthetic Oligonucleotide
attgtccaattttggg

SEQ ID NO: 3432 - DNA, 16 bp, Artificial sequence
  Synthetic Oligonucleotide
gaaattgtccaatttt

SEQ ID NO: 3433 - DNA, 16 bp, Artificial sequence
  Synthetic Oligonucleotide
tttgaaattgtccaat

SEQ ID NO: 3434 - DNA, 16 bp, Artificial sequence
  Synthetic Oligonucleotide
gcatttgaaattgtcc

SEQ ID NO: 3435 - DNA, 16 bp, Artificial sequence
  Synthetic Oligonucleotide
gcaactcatatattaa

SEQ ID NO: 3436 - DNA, 16 bp, Artificial sequence
  Synthetic Oligonucleotide
gaagcaactcatatat

SEQ ID NO: 3437 - DNA, 16 bp, Artificial sequence
  Synthetic Oligonucleotide
gaggaagcaactcata

SEQ ID NO: 3438 - DNA, 16 bp, Artificial sequence
  Synthetic Oligonucleotide
atagaggaagcaactc

SEQ ID NO: 3439 - DNA, 16 bp, Artificial sequence
  Synthetic Oligonucleotide
caaatagaggaagcaa

SEQ ID NO: 3440 - DNA, 16 bp, Artificial sequence
  Synthetic Oligonucleotide
aaccaaatagaggaag

SEQ ID NO: 3441 - DNA, 16 bp, Artificial sequence
  Synthetic Oligonucleotide
ggaaaccaaatagagg

SEQ ID NO: 3442 - DNA, 16 bp, Artificial sequence
  Synthetic Oligonucleotide
ctttaagtgaagttac

SEQ ID NO: 3443 - DNA, 16 bp, Artificial sequence
  Synthetic Oligonucleotide
tacttactttaagtga

SEQ ID NO: 3444 - DNA, 16 bp, Artificial sequence
  Synthetic Oligonucleotide
gaaccctctttatttt

SEQ ID NO: 3445 - DNA, 16 bp, Artificial sequence
  Synthetic Oligonucleotide
aaacatgaaccctctt

SEQ ID NO: 3446 - DNA, 16 bp, Artificial sequence
  Synthetic Oligonucleotide
gatccacattgaaaac

SEQ ID NO: 3447 - DNA, 16 bp, Artificial sequence
  Synthetic Oligonucleotide
catgccttagaaatat

SEQ ID NO: 3448 - DNA, 16 bp, Artificial sequence
  Synthetic Oligonucleotide
aaatggcatgccttag

SEQ ID NO: 3449 - DNA, 16 bp, Artificial sequence
  Synthetic Oligonucleotide
gtatttcaaatggcat

SEQ ID NO: 3450 - DNA, 16 bp, Artificial sequence
  Synthetic Oligonucleotide
gcaacaaagtatttca

SEQ ID NO: 3451 - DNA, 16 bp, Artificial sequence
  Synthetic Oligonucleotide
gtatttcaacaatgca

SEQ ID NO: 3452 - DNA, 16 bp, Artificial sequence
  Synthetic Oligonucleotide
ataacattagggaaac

SEQ ID NO: 3453 - DNA, 16 bp, Artificial sequence
  Synthetic Oligonucleotide
tcatatataacattag

SEQ ID NO: 3454 - DNA, 16 bp, Artificial sequence
  Synthetic Oligonucleotide
gtggttttgagcaaag

SEQ ID NO: 3455 - DNA, 16 bp, Artificial sequence
  Synthetic Oligonucleotide
ctattgtgtggttttg

SEQ ID NO: 3456 - DNA, 16 bp, Artificial sequence
  Synthetic Oligonucleotide
ggaaagctattgtgtg

SEQ ID NO: 3457 - DNA, 16 bp, Artificial sequence
  Synthetic Oligonucleotide
tatgagtgaaatggaa

SEQ ID NO: 3458 - DNA, 16 bp, Artificial sequence
  Synthetic Oligonucleotide
agccaatatgagtgaa

SEQ ID NO: 3459 - DNA, 16 bp, Artificial sequence
  Synthetic Oligonucleotide
ctaaagagccaatatg

SEQ ID NO: 3460 - DNA, 16 bp, Artificial sequence
  Synthetic Oligonucleotide
ggtaatcttggtctaa

SEQ ID NO: 3461 - DNA, 16 bp, Artificial sequence
  Synthetic Oligonucleotide
gatgacgaagggttgg

SEQ ID NO: 3462 - DNA, 16 bp, Artificial sequence
  Synthetic Oligonucleotide
cagtgagatgacgaag

SEQ ID NO: 3463 - DNA, 16 bp, Artificial sequence
  Synthetic Oligonucleotide
tgaagtcagtgagatg

SEQ ID NO: 3464 - DNA, 16 bp, Artificial sequence
  Synthetic Oligonucleotide
aggaggtgaagtcagt

SEQ ID NO: 3465 - DNA, 16 bp, Artificial sequence
  Synthetic Oligonucleotide
gagtagaggaggtgaa

SEQ ID NO: 3466 - DNA, 16 bp, Artificial sequence
  Synthetic Oligonucleotide
taactagagtagagga

SEQ ID NO: 3467 - DNA, 16 bp, Artificial sequence
  Synthetic Oligonucleotide
tcagaataactagagt

SEQ ID NO: 3468 - DNA, 16 bp, Artificial sequence
  Synthetic Oligonucleotide
aagcggtcagaataac

SEQ ID NO: 3469 - DNA, 16 bp, Artificial sequence
  Synthetic Oligonucleotide
ctggtaaagcggtcag

SEQ ID NO: 3470 - DNA, 16 bp, Artificial sequence
  Synthetic Oligonucleotide
tgaatactggtaaagc

SEQ ID NO: 3471 - DNA, 16 bp, Artificial sequence
  Synthetic Oligonucleotide
tgtgtttgaatactgg

SEQ ID NO: 3472 - DNA, 16 bp, Artificial sequence
  Synthetic Oligonucleotide
gtttgatgtgtttgaa

SEQ ID NO: 3473 - DNA, 16 bp, Artificial sequence
  Synthetic Oligonucleotide
cagtatgtttgatgtg

SEQ ID NO: 3474 - DNA, 16 bp, Artificial sequence
  Synthetic Oligonucleotide
aggtggcagtatgttt

SEQ ID NO: 3475 - DNA, 16 bp, Artificial sequence
  Synthetic Oligonucleotide
gctttgaggtggcagt

SEQ ID NO: 3476 - DNA, 16 bp, Artificial sequence
  Synthetic Oligonucleotide
gggcaaaggctttgag

SEQ ID NO: 3477 - DNA, 16 bp, Artificial sequence
  Synthetic Oligonucleotide
caacaagggcaaaggc

SEQ ID NO: 3478 - DNA, 16 bp, Artificial sequence
  Synthetic Oligonucleotide
gaggaaacaacaaggg

SEQ ID NO: 3479 - DNA, 16 bp, Artificial sequence
  Synthetic Oligonucleotide
ccagttagaggaaaca

SEQ ID NO: 3480 - DNA, 16 bp, Artificial sequence
  Synthetic Oligonucleotide
ccagggcagaagagcg

SEQ ID NO: 3481 - DNA, 16 bp, Artificial sequence
  Synthetic Oligonucleotide
tagataccagggcaga

SEQ ID NO: 3482 - DNA, 16 bp, Artificial sequence
  Synthetic Oligonucleotide
cagagagtgggccacg

SEQ ID NO: 3483 - DNA, 16 bp, Artificial sequence
  Synthetic Oligonucleotide
ggaaatcagagagtgg

SEQ ID NO: 3484 - DNA, 16 bp, Artificial sequence
  Synthetic Oligonucleotide
cctaagggaaatcaga

SEQ ID NO: 3485 - DNA, 16 bp, Artificial sequence
  Synthetic Oligonucleotide
aacgaccctaagggaa

SEQ ID NO: 3486 - DNA, 16 bp, Artificial sequence
  Synthetic Oligonucleotide
tttgataacgacccta

SEQ ID NO: 3487 - DNA, 16 bp, Artificial sequence
  Synthetic Oligonucleotide
tttttgtttgataacg

SEQ ID NO: 3488 - DNA, 16 bp, Artificial sequence
  Synthetic Oligonucleotide
cattgggaattttttg

SEQ ID NO: 3489 - DNA, 16 bp, Artificial sequence
  Synthetic Oligonucleotide
agtcttcattgggaat

SEQ ID NO: 3490 - DNA, 16 bp, Artificial sequence
  Synthetic Oligonucleotide
cttgtaagtcttcatt

SEQ ID NO: 3491 - DNA, 16 bp, Artificial sequence
  Synthetic Oligonucleotide
agtgaccttgtaagtc

SEQ ID NO: 3492 - DNA, 16 bp, Artificial sequence
  Synthetic Oligonucleotide
tggttaagtgaccttg

SEQ ID NO: 3493 - DNA, 16 bp, Artificial sequence
  Synthetic Oligonucleotide
gatttttggttaagtg

SEQ ID NO: 3494 - DNA, 16 bp, Artificial sequence
  Synthetic Oligonucleotide
ggttgtgatttttggt

SEQ ID NO: 3495 - DNA, 16 bp, Artificial sequence
  Synthetic Oligonucleotide
ccaggcggttgtgatt

SEQ ID NO: 3496 - DNA, 16 bp, Artificial sequence
  Synthetic Oligonucleotide
atgggaccaggcggtt

SEQ ID NO: 3497 - DNA, 16 bp, Artificial sequence
  Synthetic Oligonucleotide
aagttttcagggatgg

SEQ ID NO: 3498 - DNA, 16 bp, Artificial sequence
  Synthetic Oligonucleotide
aagtagaagttttcag

SEQ ID NO: 3499 - DNA, 16 bp, Artificial sequence
  Synthetic Oligonucleotide
ctaaggaagtagaagt

SEQ ID NO: 3500 - DNA, 16 bp, Artificial sequence
  Synthetic Oligonucleotide
aagtagctaaggaagt

SEQ ID NO: 3501 - DNA, 16 bp, Artificial sequence
  Synthetic Oligonucleotide
ggagaaaagtagctaa

SEQ ID NO: 3502 - DNA, 16 bp, Artificial sequence
  Synthetic Oligonucleotide
tgtgcaggagaaaagt

SEQ ID NO: 3503 - DNA, 16 bp, Artificial sequence
  Synthetic Oligonucleotide
ggtgagtgtgcaggag

SEQ ID NO: 3504 - DNA, 16 bp, Artificial sequence
  Synthetic Oligonucleotide
aataaaggtgagtgtg

SEQ ID NO: 3505 - DNA, 16 bp, Artificial sequence
  Synthetic Oligonucleotide
tgcaggaatagaagag

SEQ ID NO: 3506 - DNA, 16 bp, Artificial sequence
  Synthetic Oligonucleotide
ttttagtgcaggaata

SEQ ID NO: 3507 - DNA, 16 bp, Artificial sequence
  Synthetic Oligonucleotide
tattcacagagcttac

SEQ ID NO: 3508 - DNA, 16 bp, Artificial sequence
  Synthetic Oligonucleotide
tccctgtattcacaga

SEQ ID NO: 3509 - DNA, 16 bp, Artificial sequence
  Synthetic Oligonucleotide
gaaaaaatccctgtat

SEQ ID NO: 3510 - DNA, 16 bp, Artificial sequence
  Synthetic Oligonucleotide
tatgaagataatggaa

SEQ ID NO: 3511 - DNA, 16 bp, Artificial sequence
  Synthetic Oligonucleotide
ggagtatatacaaata

SEQ ID NO: 3512 - DNA, 16 bp, Artificial sequence
  Synthetic Oligonucleotide
tattctggagtatata

SEQ ID NO: 3513 - DNA, 16 bp, Artificial sequence
  Synthetic Oligonucleotide
attctatattctggag

SEQ ID NO: 3514 - DNA, 16 bp, Artificial sequence
  Synthetic Oligonucleotide
catacagtattctata

SEQ ID NO: 3515 - DNA, 16 bp, Artificial sequence
  Synthetic Oligonucleotide
gtgtgccatacagtat

SEQ ID NO: 3516 - DNA, 16 bp, Artificial sequence
  Synthetic Oligonucleotide
agaaatgcctactgtg

SEQ ID NO: 3517 - DNA, 16 bp, Artificial sequence
  Synthetic Oligonucleotide
attcaacagaaatgcc

SEQ ID NO: 3518 - DNA, 16 bp, Artificial sequence
  Synthetic Oligonucleotide
gaatatgacattacat

SEQ ID NO: 3519 - DNA, 16 bp, Artificial sequence
  Synthetic Oligonucleotide
ctgtgtgaatatgaca

SEQ ID NO: 3520 - DNA, 16 bp, Artificial sequence
  Synthetic Oligonucleotide
acgcttctgtgtgaat

SEQ ID NO: 3521 - DNA, 16 bp, Artificial sequence
  Synthetic Oligonucleotide
tagcacacgcttctgt

SEQ ID NO: 3522 - DNA, 16 bp, Artificial sequence
  Synthetic Oligonucleotide
taatcatagcacacgc

SEQ ID NO: 3523 - DNA, 16 bp, Artificial sequence
  Synthetic Oligonucleotide
ccaagtaataataatc

SEQ ID NO: 3524 - DNA, 16 bp, Artificial sequence
  Synthetic Oligonucleotide
agtaatccaagtaata

SEQ ID NO: 3525 - DNA, 16 bp, Artificial sequence
  Synthetic Oligonucleotide
atttctagtaatccaa

SEQ ID NO: 3526 - DNA, 16 bp, Artificial sequence
  Synthetic Oligonucleotide
cacactatttctagta

SEQ ID NO: 3527 - DNA, 16 bp, Artificial sequence
  Synthetic Oligonucleotide
atgaggcacactattt

SEQ ID NO: 3528 - DNA, 16 bp, Artificial sequence
  Synthetic Oligonucleotide
ttaattatgaggcaca

SEQ ID NO: 3529 - DNA, 16 bp, Artificial sequence
  Synthetic Oligonucleotide
tgacctttaattatga

SEQ ID NO: 3530 - DNA, 16 bp, Artificial sequence
  Synthetic Oligonucleotide
gcaatttattgaatga

SEQ ID NO: 3531 - DNA, 16 bp, Artificial sequence
  Synthetic Oligonucleotide
gggtttgcaatttatt

SEQ ID NO: 3532 - DNA, 16 bp, Artificial sequence
  Synthetic Oligonucleotide
tgtgttgggtttgcaa

SEQ ID NO: 3533 - DNA, 16 bp, Artificial sequence
  Synthetic Oligonucleotide
tttaagtgtgttgggt

SEQ ID NO: 3534 - DNA, 16 bp, Artificial sequence
  Synthetic Oligonucleotide
gtttagcagtaacatt

SEQ ID NO: 3535 - DNA, 16 bp, Artificial sequence
  Synthetic Oligonucleotide
attcagtagtttatcg

SEQ ID NO: 3536 - DNA, 16 bp, Artificial sequence
  Synthetic Oligonucleotide
ctatatattcagtagt

SEQ ID NO: 3537 - DNA, 16 bp, Artificial sequence
  Synthetic Oligonucleotide
gcttactttctatata

SEQ ID NO: 3538 - DNA, 16 bp, Artificial sequence
  Synthetic Oligonucleotide
agtttgtttgcttact

SEQ ID NO: 3539 - DNA, 16 bp, Artificial sequence
  Synthetic Oligonucleotide
ttggcaagtttgtttg

SEQ ID NO: 3540 - DNA, 16 bp, Artificial sequence
  Synthetic Oligonucleotide
ggcaggttggcaagtt

SEQ ID NO: 3541 - DNA, 16 bp, Artificial sequence
  Synthetic Oligonucleotide
gatgttggcaggttgg

SEQ ID NO: 3542 - DNA, 16 bp, Artificial sequence
  Synthetic Oligonucleotide
aacatatctgtagatg

SEQ ID NO: 3543 - DNA, 16 bp, Artificial sequence
  Synthetic Oligonucleotide
cctgtaaacatatctg

SEQ ID NO: 3544 - DNA, 16 bp, Artificial sequence
  Synthetic Oligonucleotide
ttttgacctgtaaaca

SEQ ID NO: 3545 - DNA, 16 bp, Artificial sequence
  Synthetic Oligonucleotide
gataatttttgacctg

SEQ ID NO: 3546 - DNA, 16 bp, Artificial sequence
  Synthetic Oligonucleotide
tcttgataatttgata

SEQ ID NO: 3547 - DNA, 16 bp, Artificial sequence
  Synthetic Oligonucleotide
aggctttcttgataat

SEQ ID NO: 3548 - DNA, 16 bp, Artificial sequence
  Synthetic Oligonucleotide
tgaaccaggctttctt

SEQ ID NO: 3549 - DNA, 16 bp, Artificial sequence
  Synthetic Oligonucleotide
gataaagacataatac

SEQ ID NO: 3550 - DNA, 16 bp, Artificial sequence
  Synthetic Oligonucleotide
acctgtgataaagaca

SEQ ID NO: 3551 - DNA, 16 bp, Artificial sequence
  Synthetic Oligonucleotide
cttcagacctgtgata

SEQ ID NO: 3552 - DNA, 16 bp, Artificial sequence
  Synthetic Oligonucleotide
actgatcttcagacct

SEQ ID NO: 3553 - DNA, 16 bp, Artificial sequence
  Synthetic Oligonucleotide
ggtcttactgatcttc

SEQ ID NO: 3554 - DNA, 16 bp, Artificial sequence
  Synthetic Oligonucleotide
gttttaggtcttactg

SEQ ID NO: 3555 - DNA, 16 bp, Artificial sequence
  Synthetic Oligonucleotide
gttcagattttaagtt

SEQ ID NO: 3556 - DNA, 16 bp, Artificial sequence
  Synthetic Oligonucleotide
atattctgttcagatt

SEQ ID NO: 3557 - DNA, 16 bp, Artificial sequence
  Synthetic Oligonucleotide
atattgtaatgtattc

SEQ ID NO: 3558 - DNA, 16 bp, Artificial sequence
  Synthetic Oligonucleotide
cttagaatattgtaat

SEQ ID NO: 3559 - DNA, 16 bp, Artificial sequence
  Synthetic Oligonucleotide
gctttgcttagaatat

SEQ ID NO: 3560 - DNA, 16 bp, Artificial sequence
  Synthetic Oligonucleotide
gagactgctttgctta

SEQ ID NO: 3561 - DNA, 16 bp, Artificial sequence
  Synthetic Oligonucleotide
aaagtagagactgctt

SEQ ID NO: 3562 - DNA, 16 bp, Artificial sequence
  Synthetic Oligonucleotide
aggccaaaagtagaga

SEQ ID NO: 3563 - DNA, 16 bp, Artificial sequence
  Synthetic Oligonucleotide
tcggaaaacagagcaa

SEQ ID NO: 3564 - DNA, 16 bp, Artificial sequence
  Synthetic Oligonucleotide
cattggtcggaaaaca

SEQ ID NO: 3565 - DNA, 16 bp, Artificial sequence
  Synthetic Oligonucleotide
agcaaggcaaaaaagc

SEQ ID NO: 3566 - DNA, 16 bp, Artificial sequence
  Synthetic Oligonucleotide
gacattatttaataag

SEQ ID NO: 3567 - DNA, 16 bp, Artificial sequence
  Synthetic Oligonucleotide
atcagggacattattt

SEQ ID NO: 3568 - DNA, 16 bp, Artificial sequence
  Synthetic Oligonucleotide
tatttaatcagggaca

SEQ ID NO: 3569 - DNA, 16 bp, Artificial sequence
  Synthetic Oligonucleotide
attacctgttctcaaa

SEQ ID NO: 3570 - DNA, 16 bp, Artificial sequence
  Synthetic Oligonucleotide
gtacagattacctgtt

SEQ ID NO: 3571 - DNA, 16 bp, Artificial sequence
  Synthetic Oligonucleotide
gttattcagattgtac

SEQ ID NO: 3572 - DNA, 16 bp, Artificial sequence
  Synthetic Oligonucleotide
aacagtgttattcaga

SEQ ID NO: 3573 - DNA, 16 bp, Artificial sequence
  Synthetic Oligonucleotide
tagataaacagtgtta

SEQ ID NO: 3574 - DNA, 16 bp, Artificial sequence
  Synthetic Oligonucleotide
tgatatttagataaac

SEQ ID NO: 3575 - DNA, 16 bp, Artificial sequence
  Synthetic Oligonucleotide
ggtgtttgatatttag

SEQ ID NO: 3576 - DNA, 16 bp, Artificial sequence
  Synthetic Oligonucleotide
tataacggtgtttgat

SEQ ID NO: 3577 - DNA, 16 bp, Artificial sequence
  Synthetic Oligonucleotide
taatgttataacggtg

SEQ ID NO: 3578 - DNA, 16 bp, Artificial sequence
  Synthetic Oligonucleotide
agttcataatgttata

SEQ ID NO: 3579 - DNA, 16 bp, Artificial sequence
  Synthetic Oligonucleotide
gtctttcagttcataa

SEQ ID NO: 3580 - DNA, 16 bp, Artificial sequence
  Synthetic Oligonucleotide
acagtttgtctttcag

SEQ ID NO: 3581 - DNA, 16 bp, Artificial sequence
  Synthetic Oligonucleotide
agaagtacagtttgtc

SEQ ID NO: 3582 - DNA, 16 bp, Artificial sequence
  Synthetic Oligonucleotide
gatgtcagaagtacag

SEQ ID NO: 3583 - DNA, 16 bp, Artificial sequence
  Synthetic Oligonucleotide
agtaaggatgtcagaa

SEQ ID NO: 3584 - DNA, 16 bp, Artificial sequence
  Synthetic Oligonucleotide
aatctgagtaaggatg

SEQ ID NO: 3585 - DNA, 16 bp, Artificial sequence
  Synthetic Oligonucleotide
gaatatacaattaggg

SEQ ID NO: 3586 - DNA, 16 bp, Artificial sequence
  Synthetic Oligonucleotide
tgatactgaatataca

SEQ ID NO: 3587 - DNA, 16 bp, Artificial sequence
  Synthetic Oligonucleotide
ctgagctgataaaaga

SEQ ID NO: 3588 - DNA, 16 bp, Artificial sequence
  Synthetic Oligonucleotide
accatcatgttttaca

SEQ ID NO: 3589 - DNA, 16 bp, Artificial sequence
  Synthetic Oligonucleotide
tgtcttaccatcatgt

SEQ ID NO: 3590 - DNA, 16 bp, Artificial sequence
  Synthetic Oligonucleotide
ccaaagtgtcttacca

SEQ ID NO: 3591 - DNA, 16 bp, Artificial sequence
  Synthetic Oligonucleotide
aacccaccaaagtgtc

SEQ ID NO: 3592 - DNA, 16 bp, Artificial sequence
  Synthetic Oligonucleotide
gaaggaaacccaccaa

SEQ ID NO: 3593 - DNA, 16 bp, Artificial sequence
  Synthetic Oligonucleotide
cttcaagaaggaaacc

SEQ ID NO: 3594 - DNA, 16 bp, Artificial sequence
  Synthetic Oligonucleotide
taatagcttcaagaag

SEQ ID NO: 3595 - DNA, 16 bp, Artificial sequence
  Synthetic Oligonucleotide
gggaatttgataataa

SEQ ID NO: 3596 - DNA, 16 bp, Artificial sequence
  Synthetic Oligonucleotide
agaatagggaatttga

SEQ ID NO: 3597 - DNA, 16 bp, Artificial sequence
  Synthetic Oligonucleotide
gtcctaagaataggga

SEQ ID NO: 3598 - DNA, 16 bp, Artificial sequence
  Synthetic Oligonucleotide
gaacaagtcctaagaa

SEQ ID NO: 3599 - DNA, 16 bp, Artificial sequence
  Synthetic Oligonucleotide
agtctagaacaagtcc

SEQ ID NO: 3600 - DNA, 16 bp, Artificial sequence
  Synthetic Oligonucleotide
tcttttagtctagaac

SEQ ID NO: 3601 - DNA, 16 bp, Artificial sequence
  Synthetic Oligonucleotide
taactatcttttagtc

SEQ ID NO: 3602 - DNA, 16 bp, Artificial sequence
  Synthetic Oligonucleotide
atctcttaactatctt

SEQ ID NO: 3603 - DNA, 16 bp, Artificial sequence
  Synthetic Oligonucleotide
aactgttttcttctgg

SEQ ID NO: 3604 - DNA, 16 bp, Artificial sequence
  Synthetic Oligonucleotide
tcaatttcaagcaacg

SEQ ID NO: 3605 - DNA, 16 bp, Artificial sequence
  Synthetic Oligonucleotide
cttaattgtgaacatt

SEQ ID NO: 3606 - DNA, 16 bp, Artificial sequence
  Synthetic Oligonucleotide
agcttaattgtgaaca

SEQ ID NO: 3607 - DNA, 16 bp, Artificial sequence
  Synthetic Oligonucleotide
ggagcttaattgtgaa

SEQ ID NO: 3608 - DNA, 16 bp, Artificial sequence
  Synthetic Oligonucleotide
aaggagcttaattgtg

SEQ ID NO: 3609 - DNA, 16 bp, Artificial sequence
  Synthetic Oligonucleotide
agaaggagcttaattg

SEQ ID NO: 3610 - DNA, 16 bp, Artificial sequence
  Synthetic Oligonucleotide
aaagaaggagcttaat

SEQ ID NO: 3611 - DNA, 16 bp, Artificial sequence
  Synthetic Oligonucleotide
ctagaggaacaataaa

SEQ ID NO: 3612 - DNA, 16 bp, Artificial sequence
  Synthetic Oligonucleotide
taactagaggaacaat

SEQ ID NO: 3613 - DNA, 16 bp, Artificial sequence
  Synthetic Oligonucleotide
aataactagaggaaca

SEQ ID NO: 3614 - DNA, 16 bp, Artificial sequence
  Synthetic Oligonucleotide
ggaaataactagagga

SEQ ID NO: 3615 - DNA, 16 bp, Artificial sequence
  Synthetic Oligonucleotide
gaggaaataactagag

SEQ ID NO: 3616 - DNA, 16 bp, Artificial sequence
  Synthetic Oligonucleotide
tggaggaaataactag

SEQ ID NO: 3617 - DNA, 16 bp, Artificial sequence
  Synthetic Oligonucleotide
tctggaggaaataact

SEQ ID NO: 3618 - DNA, 16 bp, Artificial sequence
  Synthetic Oligonucleotide
caattctggaggaaat

SEQ ID NO: 3619 - DNA, 16 bp, Artificial sequence
  Synthetic Oligonucleotide
atcaattctggaggaa

SEQ ID NO: 3620 - DNA, 16 bp, Artificial sequence
  Synthetic Oligonucleotide
tgatcaattctggagg

SEQ ID NO: 3621 - DNA, 16 bp, Artificial sequence
  Synthetic Oligonucleotide
ttgtcttgatcaattc

SEQ ID NO: 3622 - DNA, 16 bp, Artificial sequence
  Synthetic Oligonucleotide
aattgtcttgatcaat

SEQ ID NO: 3623 - DNA, 16 bp, Artificial sequence
  Synthetic Oligonucleotide
tgaattgtcttgatca

SEQ ID NO: 3624 - DNA, 16 bp, Artificial sequence
  Synthetic Oligonucleotide
gatgaattgtcttgat

SEQ ID NO: 3625 - DNA, 16 bp, Artificial sequence
  Synthetic Oligonucleotide
atgatgaattgtcttg

SEQ ID NO: 3626 - DNA, 16 bp, Artificial sequence
  Synthetic Oligonucleotide
caaatgatgaattgtc

SEQ ID NO: 3627 - DNA, 16 bp, Artificial sequence
  Synthetic Oligonucleotide
atcaaatgatgaattg

SEQ ID NO: 3628 - DNA, 16 bp, Artificial sequence
  Synthetic Oligonucleotide
gatagagaatcaaatg

SEQ ID NO: 3629 - DNA, 16 bp, Artificial sequence
  Synthetic Oligonucleotide
tggagatagagaatca

SEQ ID NO: 3630 - DNA, 16 bp, Artificial sequence
  Synthetic Oligonucleotide
tctggagatagagaat

SEQ ID NO: 3631 - DNA, 16 bp, Artificial sequence
  Synthetic Oligonucleotide
tttggctctggagata

SEQ ID NO: 3632 - DNA, 16 bp, Artificial sequence
  Synthetic Oligonucleotide
attttggctctggaga

SEQ ID NO: 3633 - DNA, 16 bp, Artificial sequence
  Synthetic Oligonucleotide
atcttgattttggctc

SEQ ID NO: 3634 - DNA, 16 bp, Artificial sequence
  Synthetic Oligonucleotide
gcaaatcttgattttg

SEQ ID NO: 3635 - DNA, 16 bp, Artificial sequence
  Synthetic Oligonucleotide
tagcaaatcttgattt

SEQ ID NO: 3636 - DNA, 16 bp, Artificial sequence
  Synthetic Oligonucleotide
catagcaaatcttgat

SEQ ID NO: 3637 - DNA, 16 bp, Artificial sequence
  Synthetic Oligonucleotide
aacatagcaaatcttg

SEQ ID NO: 3638 - DNA, 16 bp, Artificial sequence
  Synthetic Oligonucleotide
ctaacatagcaaatct

SEQ ID NO: 3639 - DNA, 16 bp, Artificial sequence
  Synthetic Oligonucleotide
gtctaacatagcaaat

SEQ ID NO: 3640 - DNA, 16 bp, Artificial sequence
  Synthetic Oligonucleotide
taaaatttttacatcg

SEQ ID NO: 3641 - DNA, 16 bp, Artificial sequence
  Synthetic Oligonucleotide
ggctaaaatttttaca

SEQ ID NO: 3642 - DNA, 16 bp, Artificial sequence
  Synthetic Oligonucleotide
ccattggctaaaattt

SEQ ID NO: 3643 - DNA, 16 bp, Artificial sequence
  Synthetic Oligonucleotide
ggccattggctaaaat

SEQ ID NO: 3644 - DNA, 16 bp, Artificial sequence
  Synthetic Oligonucleotide
gaggccattggctaaa

SEQ ID NO: 3645 - DNA, 16 bp, Artificial sequence
  Synthetic Oligonucleotide
aggaggccattggcta

SEQ ID NO: 3646 - DNA, 16 bp, Artificial sequence
  Synthetic Oligonucleotide
gaaggaggccattggc

SEQ ID NO: 3647 - DNA, 16 bp, Artificial sequence
  Synthetic Oligonucleotide
ctgaaggaggccattg

SEQ ID NO: 3648 - DNA, 16 bp, Artificial sequence
  Synthetic Oligonucleotide
aactgaaggaggccat

SEQ ID NO: 3649 - DNA, 16 bp, Artificial sequence
  Synthetic Oligonucleotide
ccaactgaaggaggcc

SEQ ID NO: 3650 - DNA, 16 bp, Artificial sequence
  Synthetic Oligonucleotide
tcccaactgaaggagg

SEQ ID NO: 3651 - DNA, 16 bp, Artificial sequence
  Synthetic Oligonucleotide
tgtcccaactgaagga

SEQ ID NO: 3652 - DNA, 16 bp, Artificial sequence
  Synthetic Oligonucleotide
catgtcccaactgaag

SEQ ID NO: 3653 - DNA, 16 bp, Artificial sequence
  Synthetic Oligonucleotide
accatgtcccaactga

SEQ ID NO: 3654 - DNA, 16 bp, Artificial sequence
  Synthetic Oligonucleotide
agaccatgtcccaact

SEQ ID NO: 3655 - DNA, 16 bp, Artificial sequence
  Synthetic Oligonucleotide
taagaccatgtcccaa

SEQ ID NO: 3656 - DNA, 16 bp, Artificial sequence
  Synthetic Oligonucleotide
tttaagaccatgtccc

SEQ ID NO: 3657 - DNA, 16 bp, Artificial sequence
  Synthetic Oligonucleotide
tctttaagaccatgtc

SEQ ID NO: 3658 - DNA, 16 bp, Artificial sequence
  Synthetic Oligonucleotide
agtctttaagaccatg

SEQ ID NO: 3659 - DNA, 16 bp, Artificial sequence
  Synthetic Oligonucleotide
aaagtctttaagacca

SEQ ID NO: 3660 - DNA, 16 bp, Artificial sequence
  Synthetic Oligonucleotide
acaaagtctttaagac

SEQ ID NO: 3661 - DNA, 16 bp, Artificial sequence
  Synthetic Oligonucleotide
ggacaaagtctttaag

SEQ ID NO: 3662 - DNA, 16 bp, Artificial sequence
  Synthetic Oligonucleotide
atggacaaagtcttta

SEQ ID NO: 3663 - DNA, 16 bp, Artificial sequence
  Synthetic Oligonucleotide
ttatggacaaagtctt

SEQ ID NO: 3664 - DNA, 16 bp, Artificial sequence
  Synthetic Oligonucleotide
tcttatggacaaagtc

SEQ ID NO: 3665 - DNA, 16 bp, Artificial sequence
  Synthetic Oligonucleotide
cgtcttatggacaaag

SEQ ID NO: 3666 - DNA, 16 bp, Artificial sequence
  Synthetic Oligonucleotide
ttaatttggcccttcg

SEQ ID NO: 3667 - DNA, 16 bp, Artificial sequence
  Synthetic Oligonucleotide
cattaatttggccctt

SEQ ID NO: 3668 - DNA, 16 bp, Artificial sequence
  Synthetic Oligonucleotide
gtcattaatttggccc

SEQ ID NO: 3669 - DNA, 16 bp, Artificial sequence
  Synthetic Oligonucleotide
atgtcattaatttggc

SEQ ID NO: 3670 - DNA, 16 bp, Artificial sequence
  Synthetic Oligonucleotide
tatgttgagtttttga

SEQ ID NO: 3671 - DNA, 16 bp, Artificial sequence
  Synthetic Oligonucleotide
tcaaatatgttgagtt

SEQ ID NO: 3672 - DNA, 16 bp, Artificial sequence
  Synthetic Oligonucleotide
gatcaaatatgttgag

SEQ ID NO: 3673 - DNA, 16 bp, Artificial sequence
  Synthetic Oligonucleotide
gtacaattaccagtcc

SEQ ID NO: 3674 - DNA, 16 bp, Artificial sequence
  Synthetic Oligonucleotide
ctgtacaattaccagt

SEQ ID NO: 3675 - DNA, 16 bp, Artificial sequence
  Synthetic Oligonucleotide
aactgtacaattacca

SEQ ID NO: 3676 - DNA, 16 bp, Artificial sequence
  Synthetic Oligonucleotide
agaactgtacaattac

SEQ ID NO: 3677 - DNA, 16 bp, Artificial sequence
  Synthetic Oligonucleotide
taagaactgtacaatt

SEQ ID NO: 3678 - DNA, 16 bp, Artificial sequence
  Synthetic Oligonucleotide
catttaagaactgtac

SEQ ID NO: 3679 - DNA, 16 bp, Artificial sequence
  Synthetic Oligonucleotide
tactacaacatttaag

SEQ ID NO: 3680 - DNA, 16 bp, Artificial sequence
  Synthetic Oligonucleotide
ttaatactacaacatt

SEQ ID NO: 3681 - DNA, 16 bp, Artificial sequence
  Synthetic Oligonucleotide
ttgaaattaatactac

SEQ ID NO: 3682 - DNA, 16 bp, Artificial sequence
  Synthetic Oligonucleotide
gttttgaaattaatac

SEQ ID NO: 3683 - DNA, 16 bp, Artificial sequence
  Synthetic Oligonucleotide
cgatttttagttttga

SEQ ID NO: 3684 - DNA, 16 bp, Artificial sequence
  Synthetic Oligonucleotide
gacgatttttagtttt

SEQ ID NO: 3685 - DNA, 16 bp, Artificial sequence
  Synthetic Oligonucleotide
ctgacgatttttagtt

SEQ ID NO: 3686 - DNA, 16 bp, Artificial sequence
  Synthetic Oligonucleotide
tgctgacgatttttag

SEQ ID NO: 3687 - DNA, 16 bp, Artificial sequence
  Synthetic Oligonucleotide
tgtgctgacgattttt

SEQ ID NO: 3688 - DNA, 16 bp, Artificial sequence
  Synthetic Oligonucleotide
tctgtgctgacgattt

SEQ ID NO: 3689 - DNA, 16 bp, Artificial sequence
  Synthetic Oligonucleotide
tacacatactctgtgc

SEQ ID NO: 3690 - DNA, 16 bp, Artificial sequence
  Synthetic Oligonucleotide
tttacacatactctgt

SEQ ID NO: 3691 - DNA, 16 bp, Artificial sequence
  Synthetic Oligonucleotide
gatttttacacatact

SEQ ID NO: 3692 - DNA, 16 bp, Artificial sequence
  Synthetic Oligonucleotide
gaagcatcagtttaaa

SEQ ID NO: 3693 - DNA, 16 bp, Artificial sequence
  Synthetic Oligonucleotide
atgaagcatcagttta

SEQ ID NO: 3694 - DNA, 16 bp, Artificial sequence
  Synthetic Oligonucleotide
ttgtagcaaaatgaag

SEQ ID NO: 3695 - DNA, 16 bp, Artificial sequence
  Synthetic Oligonucleotide
catttactccaaatta

SEQ ID NO: 3696 - DNA, 16 bp, Artificial sequence
  Synthetic Oligonucleotide
cattaggtttcataaa

SEQ ID NO: 3697 - DNA, 16 bp, Artificial sequence
  Synthetic Oligonucleotide
ttcattaggtttcata

SEQ ID NO: 3698 - DNA, 16 bp, Artificial sequence
  Synthetic Oligonucleotide
gcttcattaggtttca

SEQ ID NO: 3699 - DNA, 16 bp, Artificial sequence
  Synthetic Oligonucleotide
ctgcttcattaggttt

SEQ ID NO: 3700 - DNA, 16 bp, Artificial sequence
  Synthetic Oligonucleotide
ttctgcttcattaggt

SEQ ID NO: 3701 - DNA, 16 bp, Artificial sequence
  Synthetic Oligonucleotide
aattctgcttcattag

SEQ ID NO: 3702 - DNA, 16 bp, Artificial sequence
  Synthetic Oligonucleotide
cagtatttaattctgc

SEQ ID NO: 3703 - DNA, 16 bp, Artificial sequence
  Synthetic Oligonucleotide
gaacttattttaatac

SEQ ID NO: 3704 - DNA, 16 bp, Artificial sequence
  Synthetic Oligonucleotide
gcgaacttattttaat

SEQ ID NO: 3705 - DNA, 16 bp, Artificial sequence
  Synthetic Oligonucleotide
cagcgaacttatttta

SEQ ID NO: 3706 - DNA, 16 bp, Artificial sequence
  Synthetic Oligonucleotide
gacagcgaacttattt

SEQ ID NO: 3707 - DNA, 16 bp, Artificial sequence
  Synthetic Oligonucleotide
aagacagcgaacttat

SEQ ID NO: 3708 - DNA, 16 bp, Artificial sequence
  Synthetic Oligonucleotide
tttaaagacagcgaac

SEQ ID NO: 3709 - DNA, 16 bp, Artificial sequence
  Synthetic Oligonucleotide
gtcatctccatttgtt

SEQ ID NO: 3710 - DNA, 16 bp, Artificial sequence
  Synthetic Oligonucleotide
tagtcatctccatttg

SEQ ID NO: 3711 - DNA, 16 bp, Artificial sequence
  Synthetic Oligonucleotide
acttagtagtcatctc

SEQ ID NO: 3712 - DNA, 16 bp, Artificial sequence
  Synthetic Oligonucleotide
tgacttagtagtcatc

SEQ ID NO: 3713 - DNA, 16 bp, Artificial sequence
  Synthetic Oligonucleotide
tgtgacttagtagtca

SEQ ID NO: 3714 - DNA, 16 bp, Artificial sequence
  Synthetic Oligonucleotide
aatgtgacttagtagt

SEQ ID NO: 3715 - DNA, 16 bp, Artificial sequence
  Synthetic Oligonucleotide
tcaatgtgacttagta

SEQ ID NO: 3716 - DNA, 16 bp, Artificial sequence
  Synthetic Oligonucleotide
agtcaatgtgacttag

SEQ ID NO: 3717 - DNA, 16 bp, Artificial sequence
  Synthetic Oligonucleotide
aaagtcaatgtgactt

SEQ ID NO: 3718 - DNA, 16 bp, Artificial sequence
  Synthetic Oligonucleotide
ttaaagtcaatgtgac

SEQ ID NO: 3719 - DNA, 16 bp, Artificial sequence
  Synthetic Oligonucleotide
tgttaaagtcaatgtg

SEQ ID NO: 3720 - DNA, 16 bp, Artificial sequence
  Synthetic Oligonucleotide
catgttaaagtcaatg

SEQ ID NO: 3721 - DNA, 16 bp, Artificial sequence
  Synthetic Oligonucleotide
ctcatgttaaagtcaa

SEQ ID NO: 3722 - DNA, 16 bp, Artificial sequence
  Synthetic Oligonucleotide
acctcatgttaaagtc

SEQ ID NO: 3723 - DNA, 16 bp, Artificial sequence
  Synthetic Oligonucleotide
atacctcatgttaaag

SEQ ID NO: 3724 - DNA, 16 bp, Artificial sequence
  Synthetic Oligonucleotide
tgatacctcatgttaa

SEQ ID NO: 3725 - DNA, 16 bp, Artificial sequence
  Synthetic Oligonucleotide
agtgatacctcatgtt

SEQ ID NO: 3726 - DNA, 16 bp, Artificial sequence
  Synthetic Oligonucleotide
atagtgatacctcatg

SEQ ID NO: 3727 - DNA, 16 bp, Artificial sequence
  Synthetic Oligonucleotide
gtatagtgatacctca

SEQ ID NO: 3728 - DNA, 16 bp, Artificial sequence
  Synthetic Oligonucleotide
aggtatagtgatacct

SEQ ID NO: 3729 - DNA, 16 bp, Artificial sequence
  Synthetic Oligonucleotide
taaggtatagtgatac

SEQ ID NO: 3730 - DNA, 16 bp, Artificial sequence
  Synthetic Oligonucleotide
aataaggtatagtgat

SEQ ID NO: 3731 - DNA, 16 bp, Artificial sequence
  Synthetic Oligonucleotide
gtaaacttattgataa

SEQ ID NO: 3732 - DNA, 16 bp, Artificial sequence
  Synthetic Oligonucleotide
ggcatagtaaacttat

SEQ ID NO: 3733 - DNA, 16 bp, Artificial sequence
  Synthetic Oligonucleotide
aattttggcatagtaa

SEQ ID NO: 3734 - DNA, 16 bp, Artificial sequence
  Synthetic Oligonucleotide
ggcaattaatgaattt

SEQ ID NO: 3735 - DNA, 16 bp, Artificial sequence
  Synthetic Oligonucleotide
gtgaaaggcaattaat

SEQ ID NO: 3736 - DNA, 16 bp, Artificial sequence
  Synthetic Oligonucleotide
agttaagtgaaaggca

SEQ ID NO: 3737 - DNA, 16 bp, Artificial sequence
  Synthetic Oligonucleotide
cccaaaagttaagtga

SEQ ID NO: 3738 - DNA, 16 bp, Artificial sequence
  Synthetic Oligonucleotide
tatggtcccaaaagtt

SEQ ID NO: 3739 - DNA, 16 bp, Artificial sequence
  Synthetic Oligonucleotide
atttattatggtccca

SEQ ID NO: 3740 - DNA, 16 bp, Artificial sequence
  Synthetic Oligonucleotide
gttatggcaatacatt

SEQ ID NO: 3741 - DNA, 16 bp, Artificial sequence
  Synthetic Oligonucleotide
attaatgttatggcaa

SEQ ID NO: 3742 - DNA, 16 bp, Artificial sequence
  Synthetic Oligonucleotide
gtagtttattaatgtt

SEQ ID NO: 3743 - DNA, 16 bp, Artificial sequence
  Synthetic Oligonucleotide
tgtaaggtagtttatt

SEQ ID NO: 3744 - DNA, 16 bp, Artificial sequence
  Synthetic Oligonucleotide
tggttttgtaaggtag

SEQ ID NO: 3745 - DNA, 16 bp, Artificial sequence
  Synthetic Oligonucleotide
aattggtggttttgta

SEQ ID NO: 3746 - DNA, 16 bp, Artificial sequence
  Synthetic Oligonucleotide
gattttaattggtggt

SEQ ID NO: 3747 - DNA, 16 bp, Artificial sequence
  Synthetic Oligonucleotide
gatgtaaataacactt

SEQ ID NO: 3748 - DNA, 16 bp, Artificial sequence
  Synthetic Oligonucleotide
ttgacagatgtaaata

SEQ ID NO: 3749 - DNA, 16 bp, Artificial sequence
  Synthetic Oligonucleotide
tttatgttgacagatg

SEQ ID NO: 3750 - DNA, 16 bp, Artificial sequence
  Synthetic Oligonucleotide
agtagatttatgttga

SEQ ID NO: 3751 - DNA, 16 bp, Artificial sequence
  Synthetic Oligonucleotide
cctgaatataatgaat

SEQ ID NO: 3752 - DNA, 16 bp, Artificial sequence
  Synthetic Oligonucleotide
ggactacctgaatata

SEQ ID NO: 3753 - DNA, 16 bp, Artificial sequence
  Synthetic Oligonucleotide
accatcaagcctccca

SEQ ID NO: 3754 - DNA, 16 bp, Artificial sequence
  Synthetic Oligonucleotide
ccccttaccatcaagc

SEQ ID NO: 3755 - DNA, 16 bp, Artificial sequence
  Synthetic Oligonucleotide
tgtagtccccttacca

SEQ ID NO: 3756 - DNA, 16 bp, Artificial sequence
  Synthetic Oligonucleotide
attgaatgtagtcccc

SEQ ID NO: 3757 - DNA, 16 bp, Artificial sequence
  Synthetic Oligonucleotide
gattagcaagtgaatg

SEQ ID NO: 3758 - DNA, 16 bp, Artificial sequence
  Synthetic Oligonucleotide
tttgtagattagcaag

SEQ ID NO: 3759 - DNA, 16 bp, Artificial sequence
  Synthetic Oligonucleotide
aagaggttctcagtaa

SEQ ID NO: 3760 - DNA, 16 bp, Artificial sequence
  Synthetic Oligonucleotide
gtccataagaggttct

SEQ ID NO: 3761 - DNA, 16 bp, Artificial sequence
  Synthetic Oligonucleotide
tacctggtccataaga

SEQ ID NO: 3762 - DNA, 16 bp, Artificial sequence
  Synthetic Oligonucleotide
tcctaatacctggtcc

SEQ ID NO: 3763 - DNA, 16 bp, Artificial sequence
  Synthetic Oligonucleotide
tacttttcctaatacc

SEQ ID NO: 3764 - DNA, 16 bp, Artificial sequence
  Synthetic Oligonucleotide
cgttactacttttcct

SEQ ID NO: 3765 - DNA, 16 bp, Artificial sequence
  Synthetic Oligonucleotide
ctgagactgcttctcg

SEQ ID NO: 3766 - DNA, 16 bp, Artificial sequence
  Synthetic Oligonucleotide
tgaaggctgagactgc

SEQ ID NO: 3767 - DNA, 16 bp, Artificial sequence
  Synthetic Oligonucleotide
taaattatatgaaggc

SEQ ID NO: 3768 - DNA, 16 bp, Artificial sequence
  Synthetic Oligonucleotide
gtaattgtttgataat

SEQ ID NO: 3769 - DNA, 16 bp, Artificial sequence
  Synthetic Oligonucleotide
tactaacaaatgtgta

SEQ ID NO: 3770 - DNA, 16 bp, Artificial sequence
  Synthetic Oligonucleotide
gtaatttactaacaaa

SEQ ID NO: 3771 - DNA, 16 bp, Artificial sequence
  Synthetic Oligonucleotide
ataagtgtaatttact

SEQ ID NO: 3772 - DNA, 16 bp, Artificial sequence
  Synthetic Oligonucleotide
gttgtaataagtgtaa

SEQ ID NO: 3773 - DNA, 16 bp, Artificial sequence
  Synthetic Oligonucleotide
gtgataaatataattc

SEQ ID NO: 3774 - DNA, 16 bp, Artificial sequence
  Synthetic Oligonucleotide
catgtaattgtgataa

SEQ ID NO: 3775 - DNA, 16 bp, Artificial sequence
  Synthetic Oligonucleotide
gtatatttaagaacag

SEQ ID NO: 3776 - DNA, 16 bp, Artificial sequence
  Synthetic Oligonucleotide
ttgtgataagtatatt

SEQ ID NO: 3777 - DNA, 16 bp, Artificial sequence
  Synthetic Oligonucleotide
tggaattaaattgtga

SEQ ID NO: 3778 - DNA, 16 bp, Artificial sequence
  Synthetic Oligonucleotide
aagccgtggaattaaa

SEQ ID NO: 3779 - DNA, 16 bp, Artificial sequence
  Synthetic Oligonucleotide
cattgtaagccgtgga

SEQ ID NO: 3780 - DNA, 16 bp, Artificial sequence
  Synthetic Oligonucleotide
tatgatcattgtaagc

SEQ ID NO: 3781 - DNA, 16 bp, Artificial sequence
  Synthetic Oligonucleotide
tatagttatgatcatt

SEQ ID NO: 3782 - DNA, 16 bp, Artificial sequence
  Synthetic Oligonucleotide
gacataacatttaatc

SEQ ID NO: 3783 - DNA, 16 bp, Artificial sequence
  Synthetic Oligonucleotide
acttatgacataacat

SEQ ID NO: 3784 - DNA, 16 bp, Artificial sequence
  Synthetic Oligonucleotide
gttactacttatgaca

SEQ ID NO: 3785 - DNA, 16 bp, Artificial sequence
  Synthetic Oligonucleotide
gtaacagttactactt

SEQ ID NO: 3786 - DNA, 16 bp, Artificial sequence
  Synthetic Oligonucleotide
gcttatttgtaacagt

SEQ ID NO: 3787 - DNA, 16 bp, Artificial sequence
  Synthetic Oligonucleotide
ttcacagcttatttgt

SEQ ID NO: 3788 - DNA, 16 bp, Artificial sequence
  Synthetic Oligonucleotide
gttcttttcacagctt

SEQ ID NO: 3789 - DNA, 16 bp, Artificial sequence
  Synthetic Oligonucleotide
ggagtggttcttttca

SEQ ID NO: 3790 - DNA, 16 bp, Artificial sequence
  Synthetic Oligonucleotide
atgctaggagtggttc

SEQ ID NO: 3791 - DNA, 16 bp, Artificial sequence
  Synthetic Oligonucleotide
tgactaatgctaggag

SEQ ID NO: 3792 - DNA, 16 bp, Artificial sequence
  Synthetic Oligonucleotide
atagagtgactaatgc

SEQ ID NO: 3793 - DNA, 16 bp, Artificial sequence
  Synthetic Oligonucleotide
gagagaatagagtgac

SEQ ID NO: 3794 - DNA, 16 bp, Artificial sequence
  Synthetic Oligonucleotide
attgatatgtaaaacg

SEQ ID NO: 3795 - DNA, 16 bp, Artificial sequence
  Synthetic Oligonucleotide
caattaattgatatgt

SEQ ID NO: 3796 - DNA, 16 bp, Artificial sequence
  Synthetic Oligonucleotide
ccttttaacttccaat

SEQ ID NO: 3797 - DNA, 16 bp, Artificial sequence
  Synthetic Oligonucleotide
cctggtccttttaact

SEQ ID NO: 3798 - DNA, 16 bp, Artificial sequence
  Synthetic Oligonucleotide
gagtttcctggtcctt

SEQ ID NO: 3799 - DNA, 16 bp, Artificial sequence
  Synthetic Oligonucleotide
atgtctgagtttcctg

SEQ ID NO: 3800 - DNA, 16 bp, Artificial sequence
  Synthetic Oligonucleotide
tactgtatgtctgagt

SEQ ID NO: 3801 - DNA, 16 bp, Artificial sequence
  Synthetic Oligonucleotide
ccatacattctatata

SEQ ID NO: 3802 - DNA, 16 bp, Artificial sequence
  Synthetic Oligonucleotide
tataagccatacattc

SEQ ID NO: 3803 - DNA, 16 bp, Artificial sequence
  Synthetic Oligonucleotide
attcattataagccat

SEQ ID NO: 3804 - DNA, 16 bp, Artificial sequence
  Synthetic Oligonucleotide
cattgagttaactaat

SEQ ID NO: 3805 - DNA, 16 bp, Artificial sequence
  Synthetic Oligonucleotide
aatttgcattgagtta

SEQ ID NO: 3806 - DNA, 16 bp, Artificial sequence
  Synthetic Oligonucleotide
tgaagttacttctggg

SEQ ID NO: 3807 - DNA, 16 bp, Artificial sequence
  Synthetic Oligonucleotide
agtgaagttacttctg

SEQ ID NO: 3808 - DNA, 16 bp, Artificial sequence
  Synthetic Oligonucleotide
taagtgaagttacttc

SEQ ID NO: 3809 - DNA, 16 bp, Artificial sequence
  Synthetic Oligonucleotide
gttttaagtgaagtta

SEQ ID NO: 3810 - DNA, 16 bp, Artificial sequence
  Synthetic Oligonucleotide
aagttttaagtgaagt

SEQ ID NO: 3811 - DNA, 16 bp, Artificial sequence
  Synthetic Oligonucleotide
gtttttctacaaaagt

SEQ ID NO: 3812 - DNA, 16 bp, Artificial sequence
  Synthetic Oligonucleotide
atgctattatcttgtt

SEQ ID NO: 3813 - DNA, 16 bp, Artificial sequence
  Synthetic Oligonucleotide
tgatgctattatcttg

SEQ ID NO: 3814 - DNA, 16 bp, Artificial sequence
  Synthetic Oligonucleotide
tttgatgctattatct

SEQ ID NO: 3815 - DNA, 16 bp, Artificial sequence
  Synthetic Oligonucleotide
gtctttgatgctatta

SEQ ID NO: 3816 - DNA, 16 bp, Artificial sequence
  Synthetic Oligonucleotide
aggtctttgatgctat

SEQ ID NO: 3817 - DNA, 16 bp, Artificial sequence
  Synthetic Oligonucleotide
gaaggtctttgatgct

SEQ ID NO: 3818 - DNA, 16 bp, Artificial sequence
  Synthetic Oligonucleotide
gagaaggtctttgatg

SEQ ID NO: 3819 - DNA, 16 bp, Artificial sequence
  Synthetic Oligonucleotide
tggagaaggtctttga

SEQ ID NO: 3820 - DNA, 16 bp, Artificial sequence
  Synthetic Oligonucleotide
tctggagaaggtcttt

SEQ ID NO: 3821 - DNA, 16 bp, Artificial sequence
  Synthetic Oligonucleotide
ggtctggagaaggtct

SEQ ID NO: 3822 - DNA, 16 bp, Artificial sequence
  Synthetic Oligonucleotide
acggtctggagaaggt

SEQ ID NO: 3823 - DNA, 16 bp, Artificial sequence
  Synthetic Oligonucleotide
ccacggtctggagaag

SEQ ID NO: 3824 - DNA, 16 bp, Artificial sequence
  Synthetic Oligonucleotide
ttccacggtctggaga

SEQ ID NO: 3825 - DNA, 16 bp, Artificial sequence
  Synthetic Oligonucleotide
tcttccacggtctgga

SEQ ID NO: 3826 - DNA, 16 bp, Artificial sequence
  Synthetic Oligonucleotide
ggtcttccacggtctg

SEQ ID NO: 3827 - DNA, 16 bp, Artificial sequence
  Synthetic Oligonucleotide
ttggtcttccacggtc

SEQ ID NO: 3828 - DNA, 16 bp, Artificial sequence
  Synthetic Oligonucleotide
tattggtcttccacgg

SEQ ID NO: 3829 - DNA, 16 bp, Artificial sequence
  Synthetic Oligonucleotide
tatattggtcttccac

SEQ ID NO: 3830 - DNA, 16 bp, Artificial sequence
  Synthetic Oligonucleotide
tttatattggtcttcc

SEQ ID NO: 3831 - DNA, 16 bp, Artificial sequence
  Synthetic Oligonucleotide
tgtttatattggtctt

SEQ ID NO: 3832 - DNA, 16 bp, Artificial sequence
  Synthetic Oligonucleotide
attgtttatattggtc

SEQ ID NO: 3833 - DNA, 16 bp, Artificial sequence
  Synthetic Oligonucleotide
taattgtttatattgg

SEQ ID NO: 3834 - DNA, 16 bp, Artificial sequence
  Synthetic Oligonucleotide
ggtttaattgtttata

SEQ ID NO: 3835 - DNA, 16 bp, Artificial sequence
  Synthetic Oligonucleotide
gttggtttaattgttt

SEQ ID NO: 3836 - DNA, 16 bp, Artificial sequence
  Synthetic Oligonucleotide
ctgttggtttaattgt

SEQ ID NO: 3837 - DNA, 16 bp, Artificial sequence
  Synthetic Oligonucleotide
tgctgttggtttaatt

SEQ ID NO: 3838 - DNA, 16 bp, Artificial sequence
  Synthetic Oligonucleotide
tatgctgttggtttaa

SEQ ID NO: 3839 - DNA, 16 bp, Artificial sequence
  Synthetic Oligonucleotide
actatgctgttggttt

SEQ ID NO: 3840 - DNA, 16 bp, Artificial sequence
  Synthetic Oligonucleotide
tgactatgctgttggt

SEQ ID NO: 3841 - DNA, 16 bp, Artificial sequence
  Synthetic Oligonucleotide
tttgactatgctgttg

SEQ ID NO: 3842 - DNA, 16 bp, Artificial sequence
  Synthetic Oligonucleotide
tatttgactatgctgt

SEQ ID NO: 3843 - DNA, 16 bp, Artificial sequence
  Synthetic Oligonucleotide
tttatttgactatgct

SEQ ID NO: 3844 - DNA, 16 bp, Artificial sequence
  Synthetic Oligonucleotide
cttttatttgactatg

SEQ ID NO: 3845 - DNA, 16 bp, Artificial sequence
  Synthetic Oligonucleotide
gagctgattttctatt

SEQ ID NO: 3846 - DNA, 16 bp, Artificial sequence
  Synthetic Oligonucleotide
ctgagctgattttcta

SEQ ID NO: 3847 - DNA, 16 bp, Artificial sequence
  Synthetic Oligonucleotide
ttctgagctgattttc

SEQ ID NO: 3848 - DNA, 16 bp, Artificial sequence
  Synthetic Oligonucleotide
ccttctgagctgattt

SEQ ID NO: 3849 - DNA, 16 bp, Artificial sequence
  Synthetic Oligonucleotide
gtccttctgagctgat

SEQ ID NO: 3850 - DNA, 16 bp, Artificial sequence
  Synthetic Oligonucleotide
tagtccttctgagctg

SEQ ID NO: 3851 - DNA, 16 bp, Artificial sequence
  Synthetic Oligonucleotide
actagtccttctgagc

SEQ ID NO: 3852 - DNA, 16 bp, Artificial sequence
  Synthetic Oligonucleotide
atactagtccttctga

SEQ ID NO: 3853 - DNA, 16 bp, Artificial sequence
  Synthetic Oligonucleotide
gaatactagtccttct

SEQ ID NO: 3854 - DNA, 16 bp, Artificial sequence
  Synthetic Oligonucleotide
ttgaatactagtcctt

SEQ ID NO: 3855 - DNA, 16 bp, Artificial sequence
  Synthetic Oligonucleotide
tcttgaatactagtcc

SEQ ID NO: 3856 - DNA, 16 bp, Artificial sequence
  Synthetic Oligonucleotide
gttcttgaatactagt

SEQ ID NO: 3857 - DNA, 16 bp, Artificial sequence
  Synthetic Oligonucleotide
gggttcttgaatacta

SEQ ID NO: 3858 - DNA, 16 bp, Artificial sequence
  Synthetic Oligonucleotide
gtgggttcttgaatac

SEQ ID NO: 3859 - DNA, 16 bp, Artificial sequence
  Synthetic Oligonucleotide
ctgtgggttcttgaat

SEQ ID NO: 3860 - DNA, 16 bp, Artificial sequence
  Synthetic Oligonucleotide
ttctgtgggttcttga

SEQ ID NO: 3861 - DNA, 16 bp, Artificial sequence
  Synthetic Oligonucleotide
aaatttctgtgggttc

SEQ ID NO: 3862 - DNA, 16 bp, Artificial sequence
  Synthetic Oligonucleotide
agaaatttctgtgggt

SEQ ID NO: 3863 - DNA, 16 bp, Artificial sequence
  Synthetic Oligonucleotide
tagagaaatttctgtg

SEQ ID NO: 3864 - DNA, 16 bp, Artificial sequence
  Synthetic Oligonucleotide
gatagagaaatttctg

SEQ ID NO: 3865 - DNA, 16 bp, Artificial sequence
  Synthetic Oligonucleotide
gcttggaagatagaga

SEQ ID NO: 3866 - DNA, 16 bp, Artificial sequence
  Synthetic Oligonucleotide
tggcttggaagataga

SEQ ID NO: 3867 - DNA, 16 bp, Artificial sequence
  Synthetic Oligonucleotide
cttggcttggaagata

SEQ ID NO: 3868 - DNA, 16 bp, Artificial sequence
  Synthetic Oligonucleotide
ctcttggcttggaaga

SEQ ID NO: 3869 - DNA, 16 bp, Artificial sequence
  Synthetic Oligonucleotide
tgctcttggcttggaa

SEQ ID NO: 3870 - DNA, 16 bp, Artificial sequence
  Synthetic Oligonucleotide
ttggtgctcttggctt

SEQ ID NO: 3871 - DNA, 16 bp, Artificial sequence
  Synthetic Oligonucleotide
tcttggtgctcttggc

SEQ ID NO: 3872 - DNA, 16 bp, Artificial sequence
  Synthetic Oligonucleotide
gttcttggtgctcttg

SEQ ID NO: 3873 - DNA, 16 bp, Artificial sequence
  Synthetic Oligonucleotide
tagttcttggtgctct

SEQ ID NO: 3874 - DNA, 16 bp, Artificial sequence
  Synthetic Oligonucleotide
agtagttcttggtgct

SEQ ID NO: 3875 - DNA, 16 bp, Artificial sequence
  Synthetic Oligonucleotide
ggagtagttcttggtg

SEQ ID NO: 3876 - DNA, 16 bp, Artificial sequence
  Synthetic Oligonucleotide
agggagtagttcttgg

SEQ ID NO: 3877 - DNA, 16 bp, Artificial sequence
  Synthetic Oligonucleotide
aaagggagtagttctt

SEQ ID NO: 3878 - DNA, 16 bp, Artificial sequence
  Synthetic Oligonucleotide
agaaagggagtagttc

SEQ ID NO: 3879 - DNA, 16 bp, Artificial sequence
  Synthetic Oligonucleotide
gaagaaagggagtagt

SEQ ID NO: 3880 - DNA, 16 bp, Artificial sequence
  Synthetic Oligonucleotide
ctgaagaaagggagta

SEQ ID NO: 3881 - DNA, 16 bp, Artificial sequence
  Synthetic Oligonucleotide
tcaactgaagaaaggg

SEQ ID NO: 3882 - DNA, 16 bp, Artificial sequence
  Synthetic Oligonucleotide
tcattgaagttttgtg

SEQ ID NO: 3883 - DNA, 16 bp, Artificial sequence
  Synthetic Oligonucleotide
cgtttcattgaagttt

SEQ ID NO: 3884 - DNA, 16 bp, Artificial sequence
  Synthetic Oligonucleotide
ttgtagttctcccacg

SEQ ID NO: 3885 - DNA, 16 bp, Artificial sequence
  Synthetic Oligonucleotide
atttgtagttctccca

SEQ ID NO: 3886 - DNA, 16 bp, Artificial sequence
  Synthetic Oligonucleotide
atatttgtagttctcc

SEQ ID NO: 3887 - DNA, 16 bp, Artificial sequence
  Synthetic Oligonucleotide
ccatatttgtagttct

SEQ ID NO: 3888 - DNA, 16 bp, Artificial sequence
  Synthetic Oligonucleotide
aaccatatttgtagtt

SEQ ID NO: 3889 - DNA, 16 bp, Artificial sequence
  Synthetic Oligonucleotide
ccaaaaccatatttgt

SEQ ID NO: 3890 - DNA, 16 bp, Artificial sequence
  Synthetic Oligonucleotide
ctcccaaaaccatatt

SEQ ID NO: 3891 - DNA, 16 bp, Artificial sequence
  Synthetic Oligonucleotide
gcctcccaaaaccata

SEQ ID NO: 3892 - DNA, 16 bp, Artificial sequence
  Synthetic Oligonucleotide
aagcctcccaaaacca

SEQ ID NO: 3893 - DNA, 16 bp, Artificial sequence
  Synthetic Oligonucleotide
tcaagcctcccaaaac

SEQ ID NO: 3894 - DNA, 16 bp, Artificial sequence
  Synthetic Oligonucleotide
tccatcaagcctccca

SEQ ID NO: 3895 - DNA, 16 bp, Artificial sequence
  Synthetic Oligonucleotide
tctccatcaagcctcc

SEQ ID NO: 3896 - DNA, 16 bp, Artificial sequence
  Synthetic Oligonucleotide
attctccatcaagcct

SEQ ID NO: 3897 - DNA, 16 bp, Artificial sequence
  Synthetic Oligonucleotide
aaattctccatcaagc

SEQ ID NO: 3898 - DNA, 16 bp, Artificial sequence
  Synthetic Oligonucleotide
accaaaattctccatc

SEQ ID NO: 3899 - DNA, 16 bp, Artificial sequence
  Synthetic Oligonucleotide
caaccaaaattctcca

SEQ ID NO: 3900 - DNA, 16 bp, Artificial sequence
  Synthetic Oligonucleotide
cccaaccaaaattctc

SEQ ID NO: 3901 - DNA, 16 bp, Artificial sequence
  Synthetic Oligonucleotide
ggcccaaccaaaattc

SEQ ID NO: 3902 - DNA, 16 bp, Artificial sequence
  Synthetic Oligonucleotide
taggcccaaccaaaat

SEQ ID NO: 3903 - DNA, 16 bp, Artificial sequence
  Synthetic Oligonucleotide
tctaggcccaaccaaa

SEQ ID NO: 3904 - DNA, 16 bp, Artificial sequence
  Synthetic Oligonucleotide
tctctaggcccaacca

SEQ ID NO: 3905 - DNA, 16 bp, Artificial sequence
  Synthetic Oligonucleotide
cttctctaggcccaac

SEQ ID NO: 3906 - DNA, 16 bp, Artificial sequence
  Synthetic Oligonucleotide
atatcttctctaggcc

SEQ ID NO: 3907 - DNA, 16 bp, Artificial sequence
  Synthetic Oligonucleotide
gtatatcttctctagg

SEQ ID NO: 3908 - DNA, 16 bp, Artificial sequence
  Synthetic Oligonucleotide
gagtatatcttctcta

SEQ ID NO: 3909 - DNA, 16 bp, Artificial sequence
  Synthetic Oligonucleotide
tggagtatatcttctc

SEQ ID NO: 3910 - DNA, 16 bp, Artificial sequence
  Synthetic Oligonucleotide
tatggagtatatcttc

SEQ ID NO: 3911 - DNA, 16 bp, Artificial sequence
  Synthetic Oligonucleotide
actatggagtatatct

SEQ ID NO: 3912 - DNA, 16 bp, Artificial sequence
  Synthetic Oligonucleotide
tcactatggagtatat

SEQ ID NO: 3913 - DNA, 16 bp, Artificial sequence
  Synthetic Oligonucleotide
cttcactatggagtat

SEQ ID NO: 3914 - DNA, 16 bp, Artificial sequence
  Synthetic Oligonucleotide
tgcttcactatggagt

SEQ ID NO: 3915 - DNA, 16 bp, Artificial sequence
  Synthetic Oligonucleotide
attgcttcactatgga

SEQ ID NO: 3916 - DNA, 16 bp, Artificial sequence
  Synthetic Oligonucleotide
agattgcttcactatg

SEQ ID NO: 3917 - DNA, 16 bp, Artificial sequence
  Synthetic Oligonucleotide
ttagattgcttcacta

SEQ ID NO: 3918 - DNA, 16 bp, Artificial sequence
  Synthetic Oligonucleotide
aattagattgcttcac

SEQ ID NO: 3919 - DNA, 16 bp, Artificial sequence
  Synthetic Oligonucleotide
ataattagattgcttc

SEQ ID NO: 3920 - DNA, 16 bp, Artificial sequence
  Synthetic Oligonucleotide
acataattagattgct

SEQ ID NO: 3921 - DNA, 16 bp, Artificial sequence
  Synthetic Oligonucleotide
cgtaaaacataattag

SEQ ID NO: 3922 - DNA, 16 bp, Artificial sequence
  Synthetic Oligonucleotide
cttccaactcaattcg

SEQ ID NO: 3923 - DNA, 16 bp, Artificial sequence
  Synthetic Oligonucleotide
gtcttccaactcaatt

SEQ ID NO: 3924 - DNA, 16 bp, Artificial sequence
  Synthetic Oligonucleotide
cagtcttccaactcaa

SEQ ID NO: 3925 - DNA, 16 bp, Artificial sequence
  Synthetic Oligonucleotide
tccagtcttccaactc

SEQ ID NO: 3926 - DNA, 16 bp, Artificial sequence
  Synthetic Oligonucleotide
tttccagtcttccaac

SEQ ID NO: 3927 - DNA, 16 bp, Artificial sequence
  Synthetic Oligonucleotide
gtctttccagtcttcc

SEQ ID NO: 3928 - DNA, 16 bp, Artificial sequence
  Synthetic Oligonucleotide
ttgttgtctttccagt

SEQ ID NO: 3929 - DNA, 16 bp, Artificial sequence
  Synthetic Oligonucleotide
ataatgtttgttgtct

SEQ ID NO: 3930 - DNA, 16 bp, Artificial sequence
  Synthetic Oligonucleotide
cgtatagttggtttcg

SEQ ID NO: 3931 - DNA, 16 bp, Artificial sequence
  Synthetic Oligonucleotide
gcaactagatgtagcg

SEQ ID NO: 3932 - DNA, 16 bp, Artificial sequence
  Synthetic Oligonucleotide
tcgcaactagatgtag

SEQ ID NO: 3933 - DNA, 16 bp, Artificial sequence
  Synthetic Oligonucleotide
aatcgcaactagatgt

SEQ ID NO: 3934 - DNA, 16 bp, Artificial sequence
  Synthetic Oligonucleotide
gtaatcgcaactagat

SEQ ID NO: 3935 - DNA, 16 bp, Artificial sequence
  Synthetic Oligonucleotide
cagtaatcgcaactag

SEQ ID NO: 3936 - DNA, 16 bp, Artificial sequence
  Synthetic Oligonucleotide
gccagtaatcgcaact

SEQ ID NO: 3937 - DNA, 16 bp, Artificial sequence
  Synthetic Oligonucleotide
ttgccagtaatcgcaa

SEQ ID NO: 3938 - DNA, 16 bp, Artificial sequence
  Synthetic Oligonucleotide
cattgccagtaatcgc

SEQ ID NO: 3939 - DNA, 16 bp, Artificial sequence
  Synthetic Oligonucleotide
gacattgccagtaatc

SEQ ID NO: 3940 - DNA, 16 bp, Artificial sequence
  Synthetic Oligonucleotide
gggacattgccagtaa

SEQ ID NO: 3941 - DNA, 16 bp, Artificial sequence
  Synthetic Oligonucleotide
tccgggattgcattgg

SEQ ID NO: 3942 - DNA, 16 bp, Artificial sequence
  Synthetic Oligonucleotide
tttccgggattgcatt

SEQ ID NO: 3943 - DNA, 16 bp, Artificial sequence
  Synthetic Oligonucleotide
gttttccgggattgca

SEQ ID NO: 3944 - DNA, 16 bp, Artificial sequence
  Synthetic Oligonucleotide
ttgttttccgggattg

SEQ ID NO: 3945 - DNA, 16 bp, Artificial sequence
  Synthetic Oligonucleotide
ctttgttttccgggat

SEQ ID NO: 3946 - DNA, 16 bp, Artificial sequence
  Synthetic Oligonucleotide
atctttgttttccggg

SEQ ID NO: 3947 - DNA, 16 bp, Artificial sequence
  Synthetic Oligonucleotide
aaatctttgttttccg

SEQ ID NO: 3948 - DNA, 16 bp, Artificial sequence
  Synthetic Oligonucleotide
acaccaaatctttgtt

SEQ ID NO: 3949 - DNA, 16 bp, Artificial sequence
  Synthetic Oligonucleotide
aaacaccaaatctttg

SEQ ID NO: 3950 - DNA, 16 bp, Artificial sequence
  Synthetic Oligonucleotide
caagtagaaaacacca

SEQ ID NO: 3951 - DNA, 16 bp, Artificial sequence
  Synthetic Oligonucleotide
cccaagtagaaaacac

SEQ ID NO: 3952 - DNA, 16 bp, Artificial sequence
  Synthetic Oligonucleotide
atcccaagtagaaaac

SEQ ID NO: 3953 - DNA, 16 bp, Artificial sequence
  Synthetic Oligonucleotide
tgatcccaagtagaaa

SEQ ID NO: 3954 - DNA, 16 bp, Artificial sequence
  Synthetic Oligonucleotide
tgtgatcccaagtaga

SEQ ID NO: 3955 - DNA, 16 bp, Artificial sequence
  Synthetic Oligonucleotide
ctgatcaaatatgttg

SEQ ID NO: 3956 - DNA, 16 bp, Artificial sequence
  Synthetic Oligonucleotide
gactgatcaaatatgt

SEQ ID NO: 3957 - DNA, 16 bp, Artificial sequence
  Synthetic Oligonucleotide
aagactgatcaaatat

SEQ ID NO: 3958 - DNA, 16 bp, Artificial sequence
  Synthetic Oligonucleotide
cataaaaagactgatc

SEQ ID NO: 3959 - DNA, 16 bp, Artificial sequence
  Synthetic Oligonucleotide
gatcataaaaagactg

SEQ ID NO: 3960 - DNA, 16 bp, Artificial sequence
  Synthetic Oligonucleotide
tagatcataaaaagac

SEQ ID NO: 3961 - DNA, 16 bp, Artificial sequence
  Synthetic Oligonucleotide
gatagatcataaaaag

SEQ ID NO: 3962 - DNA, 16 bp, Artificial sequence
  Synthetic Oligonucleotide
gcgatagatcataaaa

SEQ ID NO: 3963 - DNA, 16 bp, Artificial sequence
  Synthetic Oligonucleotide
cagcgatagatcataa

SEQ ID NO: 3964 - DNA, 16 bp, Artificial sequence
  Synthetic Oligonucleotide
tttgcagcgatagatc

SEQ ID NO: 3965 - DNA, 16 bp, Artificial sequence
  Synthetic Oligonucleotide
ggtttgcagcgataga

SEQ ID NO: 3966 - DNA, 16 bp, Artificial sequence
  Synthetic Oligonucleotide
cactggtttgcagcga

SEQ ID NO: 3967 - DNA, 16 bp, Artificial sequence
  Synthetic Oligonucleotide
ttcactggtttgcagc

SEQ ID NO: 3968 - DNA, 16 bp, Artificial sequence
  Synthetic Oligonucleotide
atttcactggtttgca

SEQ ID NO: 3969 - DNA, 16 bp, Artificial sequence
  Synthetic Oligonucleotide
tgatttcactggtttg

SEQ ID NO: 3970 - DNA, 16 bp, Artificial sequence
  Synthetic Oligonucleotide
tagttcttctcagttc

SEQ ID NO: 3971 - DNA, 16 bp, Artificial sequence
  Synthetic Oligonucleotide
tgtagttcttctcagt

SEQ ID NO: 3972 - DNA, 16 bp, Artificial sequence
  Synthetic Oligonucleotide
tatgtagttcttctca

SEQ ID NO: 3973 - DNA, 16 bp, Artificial sequence
  Synthetic Oligonucleotide
tatatgtagttcttct

SEQ ID NO: 3974 - DNA, 16 bp, Artificial sequence
  Synthetic Oligonucleotide
gtttatatgtagttct

SEQ ID NO: 3975 - DNA, 16 bp, Artificial sequence
  Synthetic Oligonucleotide
gtagtttatatgtagt

SEQ ID NO: 3976 - DNA, 16 bp, Artificial sequence
  Synthetic Oligonucleotide
cttgtagtttatatgt

SEQ ID NO: 3977 - DNA, 16 bp, Artificial sequence
  Synthetic Oligonucleotide
gacttgtagtttatat

SEQ ID NO: 3978 - DNA, 16 bp, Artificial sequence
  Synthetic Oligonucleotide
ttgacttgtagtttat

SEQ ID NO: 3979 - DNA, 16 bp, Artificial sequence
  Synthetic Oligonucleotide
tttttgacttgtagtt

SEQ ID NO: 3980 - DNA, 16 bp, Artificial sequence
  Synthetic Oligonucleotide
catttttgacttgtag

SEQ ID NO: 3981 - DNA, 16 bp, Artificial sequence
  Synthetic Oligonucleotide
cctcttcatttttgac

SEQ ID NO: 3982 - DNA, 16 bp, Artificial sequence
  Synthetic Oligonucleotide
gacatattctttacct

SEQ ID NO: 3983 - DNA, 16 bp, Artificial sequence
  Synthetic Oligonucleotide
gtgacatattctttac

SEQ ID NO: 3984 - DNA, 16 bp, Artificial sequence
  Synthetic Oligonucleotide
ttcaagtgacatattc

SEQ ID NO: 3985 - DNA, 16 bp, Artificial sequence
  Synthetic Oligonucleotide
agttcaagtgacatat

SEQ ID NO: 3986 - DNA, 16 bp, Artificial sequence
  Synthetic Oligonucleotide
tgagttcaagtgacat

SEQ ID NO: 3987 - DNA, 16 bp, Artificial sequence
  Synthetic Oligonucleotide
gttgagttcaagtgac

SEQ ID NO: 3988 - DNA, 16 bp, Artificial sequence
  Synthetic Oligonucleotide
gagttgagttcaagtg

SEQ ID NO: 3989 - DNA, 16 bp, Artificial sequence
  Synthetic Oligonucleotide
ttgagttgagttcaag

SEQ ID NO: 3990 - DNA, 16 bp, Artificial sequence
  Synthetic Oligonucleotide
ttttgagttgagttca

SEQ ID NO: 3991 - DNA, 16 bp, Artificial sequence
  Synthetic Oligonucleotide
agttttgagttgagtt

SEQ ID NO: 3992 - DNA, 16 bp, Artificial sequence
  Synthetic Oligonucleotide
caagttttgagttgag

SEQ ID NO: 3993 - DNA, 16 bp, Artificial sequence
  Synthetic Oligonucleotide
ttcaagttttgagttg

SEQ ID NO: 3994 - DNA, 16 bp, Artificial sequence
  Synthetic Oligonucleotide
ctttcaagttttgagt

SEQ ID NO: 3995 - DNA, 16 bp, Artificial sequence
  Synthetic Oligonucleotide
ggctttcaagttttga

SEQ ID NO: 3996 - DNA, 16 bp, Artificial sequence
  Synthetic Oligonucleotide
gaggctttcaagtttt

SEQ ID NO: 3997 - DNA, 16 bp, Artificial sequence
  Synthetic Oligonucleotide
aggaggctttcaagtt

SEQ ID NO: 3998 - DNA, 16 bp, Artificial sequence
  Synthetic Oligonucleotide
ctaggaggctttcaag

SEQ ID NO: 3999 - DNA, 16 bp, Artificial sequence
  Synthetic Oligonucleotide
ttctaggaggctttca

SEQ ID NO: 4000 - DNA, 16 bp, Artificial sequence
  Synthetic Oligonucleotide
tcttctaggaggcttt

SEQ ID NO: 4001 - DNA, 16 bp, Artificial sequence
  Synthetic Oligonucleotide
tttcttctaggaggct

SEQ ID NO: 4002 - DNA, 16 bp, Artificial sequence
  Synthetic Oligonucleotide
gttgaagtagaatttt

SEQ ID NO: 4003 - DNA, 16 bp, Artificial sequence
  Synthetic Oligonucleotide
gttgctcttctaaata

SEQ ID NO: 4004 - DNA, 16 bp, Artificial sequence
  Synthetic Oligonucleotide
tagttgctcttctaaa

SEQ ID NO: 4005 - DNA, 16 bp, Artificial sequence
  Synthetic Oligonucleotide
gttagttgctcttcta

SEQ ID NO: 4006 - DNA, 16 bp, Artificial sequence
  Synthetic Oligonucleotide
tagttagttgctcttc

SEQ ID NO: 4007 - DNA, 16 bp, Artificial sequence
  Synthetic Oligonucleotide
aagttagttagttgct

SEQ ID NO: 4008 - DNA, 16 bp, Artificial sequence
  Synthetic Oligonucleotide
ttaagttagttagttg

SEQ ID NO: 4009 - DNA, 16 bp, Artificial sequence
  Synthetic Oligonucleotide
aattaagttagttagt

SEQ ID NO: 4010 - DNA, 16 bp, Artificial sequence
  Synthetic Oligonucleotide
tgaattaagttagtta

SEQ ID NO: 4011 - DNA, 16 bp, Artificial sequence
  Synthetic Oligonucleotide
tttgaattaagttagt

SEQ ID NO: 4012 - DNA, 16 bp, Artificial sequence
  Synthetic Oligonucleotide
ggttgattttgaatta

SEQ ID NO: 4013 - DNA, 16 bp, Artificial sequence
  Synthetic Oligonucleotide
caggttgattttgaat

SEQ ID NO: 4014 - DNA, 16 bp, Artificial sequence
  Synthetic Oligonucleotide
ttcaggttgattttga

SEQ ID NO: 4015 - DNA, 16 bp, Artificial sequence
  Synthetic Oligonucleotide
gtttcaggttgatttt

SEQ ID NO: 4016 - DNA, 16 bp, Artificial sequence
  Synthetic Oligonucleotide
gagtttcaggttgatt

SEQ ID NO: 4017 - DNA, 16 bp, Artificial sequence
  Synthetic Oligonucleotide
tggagtttcaggttga

SEQ ID NO: 4018 - DNA, 16 bp, Artificial sequence
  Synthetic Oligonucleotide
ttctggagtttcaggt

SEQ ID NO: 4019 - DNA, 16 bp, Artificial sequence
  Synthetic Oligonucleotide
tgttctggagtttcag

SEQ ID NO: 4020 - DNA, 16 bp, Artificial sequence
  Synthetic Oligonucleotide
ggtgttctggagtttc

SEQ ID NO: 4021 - DNA, 16 bp, Artificial sequence
  Synthetic Oligonucleotide
tgggtgttctggagtt

SEQ ID NO: 4022 - DNA, 16 bp, Artificial sequence
  Synthetic Oligonucleotide
tctgggtgttctggag

SEQ ID NO: 4023 - DNA, 16 bp, Artificial sequence
  Synthetic Oligonucleotide
cttctgggtgttctgg

SEQ ID NO: 4024 - DNA, 16 bp, Artificial sequence
  Synthetic Oligonucleotide
tacttctgggtgttct

SEQ ID NO: 4025 - DNA, 16 bp, Artificial sequence
  Synthetic Oligonucleotide
gttacttctgggtgtt

SEQ ID NO: 4026 - DNA, 16 bp, Artificial sequence
  Synthetic Oligonucleotide
aagttacttctgggtg

SEQ ID NO: 4027 - DNA, 16 bp, Artificial sequence
  Synthetic Oligonucleotide
ccatcatgttttacat

SEQ ID NO: 4028 - DNA, 16 bp, Artificial sequence
  Synthetic Oligonucleotide
tgccatcatgttttac

SEQ ID NO: 4029 - DNA, 16 bp, Artificial sequence
  Synthetic Oligonucleotide
gaatgccatcatgttt

SEQ ID NO: 4030 - DNA, 16 bp, Artificial sequence
  Synthetic Oligonucleotide
aggaatgccatcatgt

SEQ ID NO: 4031 - DNA, 16 bp, Artificial sequence
  Synthetic Oligonucleotide
gcaggaatgccatcat

SEQ ID NO: 4032 - DNA, 16 bp, Artificial sequence
  Synthetic Oligonucleotide
cagcaggaatgccatc

SEQ ID NO: 4033 - DNA, 16 bp, Artificial sequence
  Synthetic Oligonucleotide
ttcagcaggaatgcca

SEQ ID NO: 4034 - DNA, 16 bp, Artificial sequence
  Synthetic Oligonucleotide
cattcagcaggaatgc

SEQ ID NO: 4035 - DNA, 16 bp, Artificial sequence
  Synthetic Oligonucleotide
tacattcagcaggaat

SEQ ID NO: 4036 - DNA, 16 bp, Artificial sequence
  Synthetic Oligonucleotide
ggtacattcagcagga

SEQ ID NO: 4037 - DNA, 16 bp, Artificial sequence
  Synthetic Oligonucleotide
gtggtacattcagcag

SEQ ID NO: 4038 - DNA, 16 bp, Artificial sequence
  Synthetic Oligonucleotide
tggtggtacattcagc

SEQ ID NO: 4039 - DNA, 16 bp, Artificial sequence
  Synthetic Oligonucleotide
tataaatggtggtaca

SEQ ID NO: 4040 - DNA, 16 bp, Artificial sequence
  Synthetic Oligonucleotide
gttataaatggtggta

SEQ ID NO: 4041 - DNA, 16 bp, Artificial sequence
  Synthetic Oligonucleotide
ctgttataaatggtgg

SEQ ID NO: 4042 - DNA, 16 bp, Artificial sequence
  Synthetic Oligonucleotide
ctctgttataaatggt

SEQ ID NO: 4043 - DNA, 16 bp, Artificial sequence
  Synthetic Oligonucleotide
acctctgttataaatg

SEQ ID NO: 4044 - DNA, 16 bp, Artificial sequence
  Synthetic Oligonucleotide
tcacctctgttataaa

SEQ ID NO: 4045 - DNA, 16 bp, Artificial sequence
  Synthetic Oligonucleotide
gttcacctctgttata

SEQ ID NO: 4046 - DNA, 16 bp, Artificial sequence
  Synthetic Oligonucleotide
atgttcacctctgtta

SEQ ID NO: 4047 - DNA, 16 bp, Artificial sequence
  Synthetic Oligonucleotide
ttgtatgttcacctct

SEQ ID NO: 4048 - DNA, 16 bp, Artificial sequence
  Synthetic Oligonucleotide
acttgtatgttcacct

SEQ ID NO: 4049 - DNA, 16 bp, Artificial sequence
  Synthetic Oligonucleotide
ccacttgtatgttcac

SEQ ID NO: 4050 - DNA, 16 bp, Artificial sequence
  Synthetic Oligonucleotide
tgccacttgtatgttc

SEQ ID NO: 4051 - DNA, 16 bp, Artificial sequence
  Synthetic Oligonucleotide
catgccacttgtatgt

SEQ ID NO: 4052 - DNA, 16 bp, Artificial sequence
  Synthetic Oligonucleotide
tacatgccacttgtat

SEQ ID NO: 4053 - DNA, 16 bp, Artificial sequence
  Synthetic Oligonucleotide
catacatgccacttgt

SEQ ID NO: 4054 - DNA, 16 bp, Artificial sequence
  Synthetic Oligonucleotide
ggcatacatgccactt

SEQ ID NO: 4055 - DNA, 16 bp, Artificial sequence
  Synthetic Oligonucleotide
atggcatacatgccac

SEQ ID NO: 4056 - DNA, 16 bp, Artificial sequence
  Synthetic Oligonucleotide
tgatggcatacatgcc

SEQ ID NO: 4057 - DNA, 16 bp, Artificial sequence
  Synthetic Oligonucleotide
tctgatggcatacatg

SEQ ID NO: 4058 - DNA, 16 bp, Artificial sequence
  Synthetic Oligonucleotide
ggtctgatggcataca

SEQ ID NO: 4059 - DNA, 16 bp, Artificial sequence
  Synthetic Oligonucleotide
tgggtctgatggcata

SEQ ID NO: 4060 - DNA, 16 bp, Artificial sequence
  Synthetic Oligonucleotide
gttgctgggtctgatg

SEQ ID NO: 4061 - DNA, 16 bp, Artificial sequence
  Synthetic Oligonucleotide
gagagttgctgggtct

SEQ ID NO: 4062 - DNA, 16 bp, Artificial sequence
  Synthetic Oligonucleotide
ttgagagttgctgggt

SEQ ID NO: 4063 - DNA, 16 bp, Artificial sequence
  Synthetic Oligonucleotide
acttgagagttgctgg

SEQ ID NO: 4064 - DNA, 16 bp, Artificial sequence
  Synthetic Oligonucleotide
aaaaacttgagagttg

SEQ ID NO: 4065 - DNA, 16 bp, Artificial sequence
  Synthetic Oligonucleotide
tgaaaaacttgagagt

SEQ ID NO: 4066 - DNA, 16 bp, Artificial sequence
  Synthetic Oligonucleotide
catgaaaaacttgaga

SEQ ID NO: 4067 - DNA, 16 bp, Artificial sequence
  Synthetic Oligonucleotide
gacatgaaaaacttga

SEQ ID NO: 4068 - DNA, 16 bp, Artificial sequence
  Synthetic Oligonucleotide
tcacagtagacatgaa

SEQ ID NO: 4069 - DNA, 16 bp, Artificial sequence
  Synthetic Oligonucleotide
catcacagtagacatg

SEQ ID NO: 4070 - DNA, 16 bp, Artificial sequence
  Synthetic Oligonucleotide
aacatcacagtagaca

SEQ ID NO: 4071 - DNA, 16 bp, Artificial sequence
  Synthetic Oligonucleotide
ataacatcacagtaga

SEQ ID NO: 4072 - DNA, 16 bp, Artificial sequence
  Synthetic Oligonucleotide
atataacatcacagta

SEQ ID NO: 4073 - DNA, 16 bp, Artificial sequence
  Synthetic Oligonucleotide
tgatataacatcacag

SEQ ID NO: 4074 - DNA, 16 bp, Artificial sequence
  Synthetic Oligonucleotide
cctgatataacatcac

SEQ ID NO: 4075 - DNA, 16 bp, Artificial sequence
  Synthetic Oligonucleotide
tacctgatataacatc

SEQ ID NO: 4076 - DNA, 16 bp, Artificial sequence
  Synthetic Oligonucleotide
actacctgatataaca

SEQ ID NO: 4077 - DNA, 16 bp, Artificial sequence
  Synthetic Oligonucleotide
ggactacctgatataa

SEQ ID NO: 4078 - DNA, 16 bp, Artificial sequence
  Synthetic Oligonucleotide
atggactacctgatat

SEQ ID NO: 4079 - DNA, 16 bp, Artificial sequence
  Synthetic Oligonucleotide
ccatggactacctgat

SEQ ID NO: 4080 - DNA, 16 bp, Artificial sequence
  Synthetic Oligonucleotide
atgtccatggactacc

SEQ ID NO: 4081 - DNA, 16 bp, Artificial sequence
  Synthetic Oligonucleotide
taatgtccatggacta

SEQ ID NO: 4082 - DNA, 16 bp, Artificial sequence
  Synthetic Oligonucleotide
attaatgtccatggac

SEQ ID NO: 4083 - DNA, 16 bp, Artificial sequence
  Synthetic Oligonucleotide
gaattaatgtccatgg

SEQ ID NO: 4084 - DNA, 16 bp, Artificial sequence
  Synthetic Oligonucleotide
ttgaattaatgtccat

SEQ ID NO: 4085 - DNA, 16 bp, Artificial sequence
  Synthetic Oligonucleotide
tgttgaattaatgtcc

SEQ ID NO: 4086 - DNA, 16 bp, Artificial sequence
  Synthetic Oligonucleotide
gatgttgaattaatgt

SEQ ID NO: 4087 - DNA, 16 bp, Artificial sequence
  Synthetic Oligonucleotide
tcgatgttgaattaat

SEQ ID NO: 4088 - DNA, 16 bp, Artificial sequence
  Synthetic Oligonucleotide
attcgatgttgaatta

SEQ ID NO: 4089 - DNA, 16 bp, Artificial sequence
  Synthetic Oligonucleotide
ctattcgatgttgaat

SEQ ID NO: 4090 - DNA, 16 bp, Artificial sequence
  Synthetic Oligonucleotide
atctattcgatgttga

SEQ ID NO: 4091 - DNA, 16 bp, Artificial sequence
  Synthetic Oligonucleotide
atccatctattcgatg

SEQ ID NO: 4092 - DNA, 16 bp, Artificial sequence
  Synthetic Oligonucleotide
tgatccatctattcga

SEQ ID NO: 4093 - DNA, 16 bp, Artificial sequence
  Synthetic Oligonucleotide
tgtgatccatctattc

SEQ ID NO: 4094 - DNA, 16 bp, Artificial sequence
  Synthetic Oligonucleotide
tttgtgatccatctat

SEQ ID NO: 4095 - DNA, 16 bp, Artificial sequence
  Synthetic Oligonucleotide
gttttgtgatccatct

SEQ ID NO: 4096 - DNA, 16 bp, Artificial sequence
  Synthetic Oligonucleotide
aagttttgtgatccat

SEQ ID NO: 4097 - DNA, 16 bp, Artificial sequence
  Synthetic Oligonucleotide
tgaagttttgtgatcc

SEQ ID NO: 4098 - DNA, 16 bp, Artificial sequence
  Synthetic Oligonucleotide
attgaagttttgtgat

SEQ ID NO: 4099 - DNA, 16 bp, Artificial sequence
  Synthetic Oligonucleotide
caacattttggttgat

SEQ ID NO: 4100 - DNA, 16 bp, Artificial sequence
  Synthetic Oligonucleotide
gatcaacattttggtt

SEQ ID NO: 4101 - DNA, 16 bp, Artificial sequence
  Synthetic Oligonucleotide
gatggatcaacatttt

SEQ ID NO: 4102 - DNA, 16 bp, Artificial sequence
  Synthetic Oligonucleotide
gttggatggatcaaca

SEQ ID NO: 4103 - DNA, 16 bp, Artificial sequence
  Synthetic Oligonucleotide
ctgttggatggatcaa

SEQ ID NO: 4104 - DNA, 16 bp, Artificial sequence
  Synthetic Oligonucleotide
atctgttggatggatc

SEQ ID NO: 4105 - DNA, 16 bp, Artificial sequence
  Synthetic Oligonucleotide
ctgaatctgttggatg

SEQ ID NO: 4106 - DNA, 16 bp, Artificial sequence
  Synthetic Oligonucleotide
caaagctttctgaatc

SEQ ID NO: 4107 - DNA, 16 bp, Artificial sequence
  Synthetic Oligonucleotide
ctcagttcattcaaag

SEQ ID NO: 4108 - DNA, 16 bp, Artificial sequence
  Synthetic Oligonucleotide
gcctcagttcattcaa

SEQ ID NO: 4109 - DNA, 16 bp, Artificial sequence
  Synthetic Oligonucleotide
ttgcctcagttcattc

SEQ ID NO: 4110 - DNA, 16 bp, Artificial sequence
  Synthetic Oligonucleotide
atttgcctcagttcat

SEQ ID NO: 4111 - DNA, 16 bp, Artificial sequence
  Synthetic Oligonucleotide
aaatttgcctcagttc

SEQ ID NO: 4112 - DNA, 16 bp, Artificial sequence
  Synthetic Oligonucleotide
tttaaatttgcctcag

SEQ ID NO: 4113 - DNA, 16 bp, Artificial sequence
  Synthetic Oligonucleotide
cttttaaatttgcctc

SEQ ID NO: 4114 - DNA, 16 bp, Artificial sequence
  Synthetic Oligonucleotide
gccttttaaatttgcc

SEQ ID NO: 4115 - DNA, 16 bp, Artificial sequence
  Synthetic Oligonucleotide
gtttaaattattgcct

SEQ ID NO: 4116 - DNA, 16 bp, Artificial sequence
  Synthetic Oligonucleotide
atgaggttaatgttta

SEQ ID NO: 4117 - DNA, 16 bp, Artificial sequence
  Synthetic Oligonucleotide
gaatgaggttaatgtt

SEQ ID NO: 4118 - DNA, 16 bp, Artificial sequence
  Synthetic Oligonucleotide
tggaatgaggttaatg

SEQ ID NO: 4119 - DNA, 16 bp, Artificial sequence
  Synthetic Oligonucleotide
cttggaatgaggttaa

SEQ ID NO: 4120 - DNA, 16 bp, Artificial sequence
  Synthetic Oligonucleotide
aacttggaatgaggtt

SEQ ID NO: 4121 - DNA, 16 bp, Artificial sequence
  Synthetic Oligonucleotide
cattaacttggaatga

SEQ ID NO: 4122 - DNA, 16 bp, Artificial sequence
  Synthetic Oligonucleotide
cacattaacttggaat

SEQ ID NO: 4123 - DNA, 16 bp, Artificial sequence
  Synthetic Oligonucleotide
accacattaacttgga

SEQ ID NO: 4124 - DNA, 16 bp, Artificial sequence
  Synthetic Oligonucleotide
ttagaccacattaact

SEQ ID NO: 4125 - DNA, 16 bp, Artificial sequence
  Synthetic Oligonucleotide
tattagaccacattaa

SEQ ID NO: 4126 - DNA, 16 bp, Artificial sequence
  Synthetic Oligonucleotide
attattagaccacatt

SEQ ID NO: 4127 - DNA, 16 bp, Artificial sequence
  Synthetic Oligonucleotide
taccagattattagac

SEQ ID NO: 4128 - DNA, 16 bp, Artificial sequence
  Synthetic Oligonucleotide
aataccagattattag

SEQ ID NO: 4129 - DNA, 16 bp, Artificial sequence
  Synthetic Oligonucleotide
ttaataccagattatt

SEQ ID NO: 4130 - DNA, 16 bp, Artificial sequence
  Synthetic Oligonucleotide
atttaataccagatta

SEQ ID NO: 4131 - DNA, 16 bp, Artificial sequence
  Synthetic Oligonucleotide
ggatttaataccagat

SEQ ID NO: 4132 - DNA, 16 bp, Artificial sequence
  Synthetic Oligonucleotide
aaggatttaataccag

SEQ ID NO: 4133 - DNA, 16 bp, Artificial sequence
  Synthetic Oligonucleotide
ttaaggatttaatacc

SEQ ID NO: 4134 - DNA, 16 bp, Artificial sequence
  Synthetic Oligonucleotide
ctcttaaggatttaat

SEQ ID NO: 4135 - DNA, 16 bp, Artificial sequence
  Synthetic Oligonucleotide
ttctcttaaggattta

SEQ ID NO: 4136 - DNA, 16 bp, Artificial sequence
  Synthetic Oligonucleotide
gctttctcttaaggat

SEQ ID NO: 4137 - DNA, 16 bp, Artificial sequence
  Synthetic Oligonucleotide
aagctttctcttaagg

SEQ ID NO: 4138 - DNA, 16 bp, Artificial sequence
  Synthetic Oligonucleotide
tcaagctttctcttaa

SEQ ID NO: 4139 - DNA, 16 bp, Artificial sequence
  Synthetic Oligonucleotide
agtgactttaagataa

SEQ ID NO: 4140 - DNA, 16 bp, Artificial sequence
  Synthetic Oligonucleotide
acagtgactttaagat

SEQ ID NO: 4141 - DNA, 16 bp, Artificial sequence
  Synthetic Oligonucleotide
agacagtgactttaag

SEQ ID NO: 4142 - DNA, 16 bp, Artificial sequence
  Synthetic Oligonucleotide
aaatagacagtgactt

SEQ ID NO: 4143 - DNA, 16 bp, Artificial sequence
  Synthetic Oligonucleotide
ttaaatagacagtgac

SEQ ID NO: 4144 - DNA, 16 bp, Artificial sequence
  Synthetic Oligonucleotide
tcttaaatagacagtg

SEQ ID NO: 4145 - DNA, 16 bp, Artificial sequence
  Synthetic Oligonucleotide
aatcttaaatagacag

SEQ ID NO: 4146 - DNA, 16 bp, Artificial sequence
  Synthetic Oligonucleotide
ttaatcttaaatagac

SEQ ID NO: 4147 - DNA, 16 bp, Artificial sequence
  Synthetic Oligonucleotide
gtttaatcttaaatag

SEQ ID NO: 4148 - DNA, 16 bp, Artificial sequence
  Synthetic Oligonucleotide
gtatgtttaatcttaa

SEQ ID NO: 4149 - DNA, 16 bp, Artificial sequence
  Synthetic Oligonucleotide
attgtatgtttaatct

SEQ ID NO: 4150 - DNA, 16 bp, Artificial sequence
  Synthetic Oligonucleotide
gtgattgtatgtttaa

SEQ ID NO: 4151 - DNA, 16 bp, Artificial sequence
  Synthetic Oligonucleotide
tatgtgattgtatgtt

SEQ ID NO: 4152 - DNA, 16 bp, Artificial sequence
  Synthetic Oligonucleotide
gttatgtgattgtatg

SEQ ID NO: 4153 - DNA, 16 bp, Artificial sequence
  Synthetic Oligonucleotide
aggttatgtgattgta

SEQ ID NO: 4154 - DNA, 16 bp, Artificial sequence
  Synthetic Oligonucleotide
taaggttatgtgattg

SEQ ID NO: 4155 - DNA, 16 bp, Artificial sequence
  Synthetic Oligonucleotide
tttaaggttatgtgat

SEQ ID NO: 4156 - DNA, 16 bp, Artificial sequence
  Synthetic Oligonucleotide
tctttaaggttatgtg

SEQ ID NO: 4157 - DNA, 16 bp, Artificial sequence
  Synthetic Oligonucleotide
attctttaaggttatg

SEQ ID NO: 4158 - DNA, 16 bp, Artificial sequence
  Synthetic Oligonucleotide
gtattctttaaggtta

SEQ ID NO: 4159 - DNA, 16 bp, Artificial sequence
  Synthetic Oligonucleotide
cggtattctttaaggt

SEQ ID NO: 4160 - DNA, 16 bp, Artificial sequence
  Synthetic Oligonucleotide
aacggtattctttaag

SEQ ID NO: 4161 - DNA, 16 bp, Artificial sequence
  Synthetic Oligonucleotide
taaacggtattcttta

SEQ ID NO: 4162 - DNA, 16 bp, Artificial sequence
  Synthetic Oligonucleotide
tgtaaacggtattctt

SEQ ID NO: 4163 - DNA, 16 bp, Artificial sequence
  Synthetic Oligonucleotide
aatgtaaacggtattc

SEQ ID NO: 4164 - DNA, 16 bp, Artificial sequence
  Synthetic Oligonucleotide
tctggaagcagaccta

SEQ ID NO: 4165 - DNA, 16 bp, Artificial sequence
  Synthetic Oligonucleotide
cttctggaagcagacc

SEQ ID NO: 4166 - DNA, 16 bp, Artificial sequence
  Synthetic Oligonucleotide
aaataaggtatagtga

SEQ ID NO: 4167 - DNA, 16 bp, Artificial sequence
  Synthetic Oligonucleotide
tagtattaagtgttaa

SEQ ID NO: 4168 - DNA, 16 bp, Artificial sequence
  Synthetic Oligonucleotide
tcatagtattaagtgt

SEQ ID NO: 4169 - DNA, 16 bp, Artificial sequence
  Synthetic Oligonucleotide
agattcctttacaatt

SEQ ID NO: 4170 - DNA, 16 bp, Artificial sequence
  Synthetic Oligonucleotide
acaagattcctttaca

SEQ ID NO: 4171 - DNA, 16 bp, Artificial sequence
  Synthetic Oligonucleotide
ctgacaagattccttt

SEQ ID NO: 4172 - DNA, 16 bp, Artificial sequence
  Synthetic Oligonucleotide
tgtaatctgacaagat

SEQ ID NO: 4173 - DNA, 16 bp, Artificial sequence
  Synthetic Oligonucleotide
tactgtaatctgacaa

SEQ ID NO: 4174 - DNA, 16 bp, Artificial sequence
  Synthetic Oligonucleotide
tcttactgtaatctga

SEQ ID NO: 4175 - DNA, 16 bp, Artificial sequence
  Synthetic Oligonucleotide
cattcttactgtaatc

SEQ ID NO: 4176 - DNA, 16 bp, Artificial sequence
  Synthetic Oligonucleotide
gttcattcttactgta

SEQ ID NO: 4177 - DNA, 16 bp, Artificial sequence
  Synthetic Oligonucleotide
atatgttcattcttac

SEQ ID NO: 4178 - DNA, 16 bp, Artificial sequence
  Synthetic Oligonucleotide
gccacaaatatgttca

SEQ ID NO: 4179 - DNA, 16 bp, Artificial sequence
  Synthetic Oligonucleotide
gatgccacaaatatgt

SEQ ID NO: 4180 - DNA, 16 bp, Artificial sequence
  Synthetic Oligonucleotide
ctttaactcgatgcca

SEQ ID NO: 4181 - DNA, 16 bp, Artificial sequence
  Synthetic Oligonucleotide
aaactttaactcgatg

SEQ ID NO: 4182 - DNA, 16 bp, Artificial sequence
  Synthetic Oligonucleotide
tataaactttaactcg

SEQ ID NO: 4183 - DNA, 16 bp, Artificial sequence
  Synthetic Oligonucleotide
cacagcatatttaggg

SEQ ID NO: 4184 - DNA, 16 bp, Artificial sequence
  Synthetic Oligonucleotide
tagaatcacagcatat

SEQ ID NO: 4185 - DNA, 16 bp, Artificial sequence
  Synthetic Oligonucleotide
tattagaatcacagca

SEQ ID NO: 4186 - DNA, 16 bp, Artificial sequence
  Synthetic Oligonucleotide
aatgtattagaatcac

SEQ ID NO: 4187 - DNA, 16 bp, Artificial sequence
  Synthetic Oligonucleotide
acgaatgtattagaat

SEQ ID NO: 4188 - DNA, 16 bp, Artificial sequence
  Synthetic Oligonucleotide
tacacgaatgtattag

SEQ ID NO: 4189 - DNA, 16 bp, Artificial sequence
  Synthetic Oligonucleotide
acctacacgaatgtat

SEQ ID NO: 4190 - DNA, 16 bp, Artificial sequence
  Synthetic Oligonucleotide
aaaacctacacgaatg

SEQ ID NO: 4191 - DNA, 16 bp, Artificial sequence
  Synthetic Oligonucleotide
ttgaaaacctacacga

SEQ ID NO: 4192 - DNA, 16 bp, Artificial sequence
  Synthetic Oligonucleotide
tacttgaaaacctaca

SEQ ID NO: 4193 - DNA, 16 bp, Artificial sequence
  Synthetic Oligonucleotide
gtttatttctacttga

SEQ ID NO: 4194 - DNA, 16 bp, Artificial sequence
  Synthetic Oligonucleotide
gaggtttatttctact

SEQ ID NO: 4195 - DNA, 16 bp, Artificial sequence
  Synthetic Oligonucleotide
tacgaggtttatttct

SEQ ID NO: 4196 - DNA, 16 bp, Artificial sequence
  Synthetic Oligonucleotide
tgttacgaggtttatt

SEQ ID NO: 4197 - DNA, 16 bp, Artificial sequence
  Synthetic Oligonucleotide
acttgttacgaggttt

SEQ ID NO: 4198 - DNA, 16 bp, Artificial sequence
  Synthetic Oligonucleotide
cagtaacttgttacga

SEQ ID NO: 4199 - DNA, 16 bp, Artificial sequence
  Synthetic Oligonucleotide
gttcagtaacttgtta

SEQ ID NO: 4200 - DNA, 16 bp, Artificial sequence
  Synthetic Oligonucleotide
tcaggctgtttaaacg

SEQ ID NO: 4201 - DNA, 16 bp, Artificial sequence
  Synthetic Oligonucleotide
ttgtcaggctgtttaa

SEQ ID NO: 4202 - DNA, 16 bp, Artificial sequence
  Synthetic Oligonucleotide
tatacatgcttgtcag

SEQ ID NO: 4203 - DNA, 16 bp, Artificial sequence
  Synthetic Oligonucleotide
gtctttgtttattgaa

SEQ ID NO: 4204 - DNA, 16 bp, Artificial sequence
  Synthetic Oligonucleotide
tgggtctttgtttatt

SEQ ID NO: 4205 - DNA, 16 bp, Artificial sequence
  Synthetic Oligonucleotide
gactgggtctttgttt

SEQ ID NO: 4206 - DNA, 16 bp, Artificial sequence
  Synthetic Oligonucleotide
ataatttagggactgg

SEQ ID NO: 4207 - DNA, 16 bp, Artificial sequence
  Synthetic Oligonucleotide
tctataatttagggac

SEQ ID NO: 4208 - DNA, 16 bp, Artificial sequence
  Synthetic Oligonucleotide
cgataaacatgcaaga

SEQ ID NO: 4209 - DNA, 16 bp, Artificial sequence
  Synthetic Oligonucleotide
tgtcgataaacatgca

SEQ ID NO: 4210 - DNA, 16 bp, Artificial sequence
  Synthetic Oligonucleotide
tgatgtcgataaacat

SEQ ID NO: 4211 - DNA, 16 bp, Artificial sequence
  Synthetic Oligonucleotide
ttgtgatgtcgataaa

SEQ ID NO: 4212 - DNA, 16 bp, Artificial sequence
  Synthetic Oligonucleotide
ctgttgtgatgtcgat

SEQ ID NO: 4213 - DNA, 16 bp, Artificial sequence
  Synthetic Oligonucleotide
gatctgttgtgatgtc

SEQ ID NO: 4214 - DNA, 16 bp, Artificial sequence
  Synthetic Oligonucleotide
agggatctgttgtgat

SEQ ID NO: 4215 - DNA, 16 bp, Artificial sequence
  Synthetic Oligonucleotide
tttagggatctgttgt

SEQ ID NO: 4216 - DNA, 16 bp, Artificial sequence
  Synthetic Oligonucleotide
ggatttagggatctgt

SEQ ID NO: 4217 - DNA, 16 bp, Artificial sequence
  Synthetic Oligonucleotide
gatttagggatttagg

SEQ ID NO: 4218 - DNA, 16 bp, Artificial sequence
  Synthetic Oligonucleotide
tctttagggatttagg

SEQ ID NO: 4219 - DNA, 16 bp, Artificial sequence
  Synthetic Oligonucleotide
taatctttagggattt

SEQ ID NO: 4220 - DNA, 16 bp, Artificial sequence
  Synthetic Oligonucleotide
atctaatctttaggga

SEQ ID NO: 4221 - DNA, 16 bp, Artificial sequence
  Synthetic Oligonucleotide
tgtatctaatctttag

SEQ ID NO: 4222 - DNA, 16 bp, Artificial sequence
  Synthetic Oligonucleotide
aaatttgtatctaatc

SEQ ID NO: 4223 - DNA, 16 bp, Artificial sequence
  Synthetic Oligonucleotide
gtaaaaaatttgtatc

SEQ ID NO: 4224 - DNA, 16 bp, Artificial sequence
  Synthetic Oligonucleotide
gtggtaaaaaatttgt

SEQ ID NO: 4225 - DNA, 16 bp, Artificial sequence
  Synthetic Oligonucleotide
gatactgtggtaaaaa

SEQ ID NO: 4226 - DNA, 16 bp, Artificial sequence
  Synthetic Oligonucleotide
agtgatactgtggtaa

SEQ ID NO: 4227 - DNA, 16 bp, Artificial sequence
  Synthetic Oligonucleotide
acaagtgatactgtgg

SEQ ID NO: 4228 - DNA, 16 bp, Artificial sequence
  Synthetic Oligonucleotide
ctgacaagtgatactg

SEQ ID NO: 4229 - DNA, 16 bp, Artificial sequence
  Synthetic Oligonucleotide
attctgacaagtgata

SEQ ID NO: 4230 - DNA, 16 bp, Artificial sequence
  Synthetic Oligonucleotide
taaattctgacaagtg

SEQ ID NO: 4231 - DNA, 16 bp, Artificial sequence
  Synthetic Oligonucleotide
tactggcagttttaaa

SEQ ID NO: 4232 - DNA, 16 bp, Artificial sequence
  Synthetic Oligonucleotide
tcttactggcagtttt

SEQ ID NO: 4233 - DNA, 16 bp, Artificial sequence
  Synthetic Oligonucleotide
atttcttactggcagt

SEQ ID NO: 4234 - DNA, 16 bp, Artificial sequence
  Synthetic Oligonucleotide
aaaatttcttactggc

SEQ ID NO: 4235 - DNA, 16 bp, Artificial sequence
  Synthetic Oligonucleotide
aacaaatgggtttaat

SEQ ID NO: 4236 - DNA, 16 bp, Artificial sequence
  Synthetic Oligonucleotide
gaatatttgcaagtct

SEQ ID NO: 4237 - DNA, 16 bp, Artificial sequence
  Synthetic Oligonucleotide
tcattggtagaggaat

SEQ ID NO: 4238 - DNA, 16 bp, Artificial sequence
  Synthetic Oligonucleotide
atattttaaagtctcg

SEQ ID NO: 4239 - DNA, 16 bp, Artificial sequence
  Synthetic Oligonucleotide
gttacattattataga

SEQ ID NO: 4240 - DNA, 16 bp, Artificial sequence
  Synthetic Oligonucleotide
gtgaaatgtgttacat

SEQ ID NO: 4241 - DNA, 16 bp, Artificial sequence
  Synthetic Oligonucleotide
tcaccagtgaaatgtg

SEQ ID NO: 4242 - DNA, 16 bp, Artificial sequence
  Synthetic Oligonucleotide
catgtttcaccagtga

SEQ ID NO: 4243 - DNA, 16 bp, Artificial sequence
  Synthetic Oligonucleotide
acaagacatgtttcac

SEQ ID NO: 4244 - DNA, 16 bp, Artificial sequence
  Synthetic Oligonucleotide
catatgacaagacatg

SEQ ID NO: 4245 - DNA, 16 bp, Artificial sequence
  Synthetic Oligonucleotide
ctataatgcatatgac

SEQ ID NO: 4246 - DNA, 16 bp, Artificial sequence
  Synthetic Oligonucleotide
tcctttctataatgca

SEQ ID NO: 4247 - DNA, 16 bp, Artificial sequence
  Synthetic Oligonucleotide
tgattatcctttctat

SEQ ID NO: 4248 - DNA, 16 bp, Artificial sequence
  Synthetic Oligonucleotide
taactgaaagtctgat

SEQ ID NO: 4249 - DNA, 16 bp, Artificial sequence
  Synthetic Oligonucleotide
gtgcacaaaaatgtta

SEQ ID NO: 4250 - DNA, 16 bp, Artificial sequence
  Synthetic Oligonucleotide
agctatgtgcacaaaa

SEQ ID NO: 4251 - DNA, 16 bp, Artificial sequence
  Synthetic Oligonucleotide
gaagatagctatgtgc

SEQ ID NO: 4252 - DNA, 16 bp, Artificial sequence
  Synthetic Oligonucleotide
tttattgaagatagct

SEQ ID NO: 4253 - DNA, 16 bp, Artificial sequence
  Synthetic Oligonucleotide
tcattttagtgtatct

SEQ ID NO: 4254 - DNA, 16 bp, Artificial sequence
  Synthetic Oligonucleotide
ccttgatcattttagt

SEQ ID NO: 4255 - DNA, 16 bp, Artificial sequence
  Synthetic Oligonucleotide
tgaatcccttgatcat

SEQ ID NO: 4256 - DNA, 16 bp, Artificial sequence
  Synthetic Oligonucleotide
gttgtttagtcttgaa

SEQ ID NO: 4257 - DNA, 16 bp, Artificial sequence
  Synthetic Oligonucleotide
aattgagttgtttagt

SEQ ID NO: 4258 - DNA, 16 bp, Artificial sequence
  Synthetic Oligonucleotide
gcaactaattgagttg

SEQ ID NO: 4259 - DNA, 16 bp, Artificial sequence
  Synthetic Oligonucleotide
attggtgcaactaatt

SEQ ID NO: 4260 - DNA, 16 bp, Artificial sequence
  Synthetic Oligonucleotide
gttttttattggtgca

SEQ ID NO: 4261 - DNA, 16 bp, Artificial sequence
  Synthetic Oligonucleotide
ggacactgacagtttt

SEQ ID NO: 4262 - DNA, 16 bp, Artificial sequence
  Synthetic Oligonucleotide
caggttggacactgac

SEQ ID NO: 4263 - DNA, 16 bp, Artificial sequence
  Synthetic Oligonucleotide
taagtacaggttggac

SEQ ID NO: 4264 - DNA, 16 bp, Artificial sequence
  Synthetic Oligonucleotide
agttattaagtacagg

SEQ ID NO: 4265 - DNA, 16 bp, Artificial sequence
  Synthetic Oligonucleotide
tctgtgagttattaag

SEQ ID NO: 4266 - DNA, 16 bp, Artificial sequence
  Synthetic Oligonucleotide
accaaaattctcctga

SEQ ID NO: 4267 - DNA, 16 bp, Artificial sequence
  Synthetic Oligonucleotide
acctgaataaccctct

SEQ ID NO: 4268 - DNA, 16 bp, Artificial sequence
  Synthetic Oligonucleotide
ggtatcagaaaaagat

SEQ ID NO: 4269 - DNA, 16 bp, Artificial sequence
  Synthetic Oligonucleotide
agtattggtatcagaa

SEQ ID NO: 4270 - DNA, 16 bp, Artificial sequence
  Synthetic Oligonucleotide
ggaagatactttgaag

SEQ ID NO: 4271 - DNA, 16 bp, Artificial sequence
  Synthetic Oligonucleotide
aatgtgggaagatact

SEQ ID NO: 4272 - DNA, 16 bp, Artificial sequence
  Synthetic Oligonucleotide
cagataatagctaata

SEQ ID NO: 4273 - DNA, 16 bp, Artificial sequence
  Synthetic Oligonucleotide
tcattgcagataatag

SEQ ID NO: 4274 - DNA, 16 bp, Artificial sequence
  Synthetic Oligonucleotide
gattcggatttttaaa

SEQ ID NO: 4275 - DNA, 16 bp, Artificial sequence
  Synthetic Oligonucleotide
atttgggattcggatt

SEQ ID NO: 4276 - DNA, 16 bp, Artificial sequence
  Synthetic Oligonucleotide
acgcttatttgggatt

SEQ ID NO: 4277 - DNA, 16 bp, Artificial sequence
  Synthetic Oligonucleotide
tctagagagaaaacgc

SEQ ID NO: 4278 - DNA, 16 bp, Artificial sequence
  Synthetic Oligonucleotide
agttaagaggttttcg

SEQ ID NO: 4279 - DNA, 16 bp, Artificial sequence
  Synthetic Oligonucleotide
cattatagttaagagg

SEQ ID NO: 4280 - DNA, 16 bp, Artificial sequence
  Synthetic Oligonucleotide
cactttcattatagtt

SEQ ID NO: 4281 - DNA, 16 bp, Artificial sequence
  Synthetic Oligonucleotide
tagaatgaacactttc

SEQ ID NO: 4282 - DNA, 16 bp, Artificial sequence
  Synthetic Oligonucleotide
ttgaactagaatgaac

SEQ ID NO: 4283 - DNA, 16 bp, Artificial sequence
  Synthetic Oligonucleotide
acctgattgaactaga

SEQ ID NO: 4284 - DNA, 16 bp, Artificial sequence
  Synthetic Oligonucleotide
taaaatacctgattga

SEQ ID NO: 4285 - DNA, 16 bp, Artificial sequence
  Synthetic Oligonucleotide
tagaggtaaaatacct

SEQ ID NO: 4286 - DNA, 16 bp, Artificial sequence
  Synthetic Oligonucleotide
gaagattagaggtaaa

SEQ ID NO: 4287 - DNA, 16 bp, Artificial sequence
  Synthetic Oligonucleotide
tctgaggaagattaga

SEQ ID NO: 4288 - DNA, 16 bp, Artificial sequence
  Synthetic Oligonucleotide
tatacactaccaaaaa

SEQ ID NO: 4289 - DNA, 16 bp, Artificial sequence
  Synthetic Oligonucleotide
ataatctatacactac

SEQ ID NO: 4290 - DNA, 16 bp, Artificial sequence
  Synthetic Oligonucleotide
taagtcccaattttaa

SEQ ID NO: 4291 - DNA, 16 bp, Artificial sequence
  Synthetic Oligonucleotide
ccagttttaaataatc

SEQ ID NO: 4292 - DNA, 16 bp, Artificial sequence
  Synthetic Oligonucleotide
tgtatcccagttttaa

SEQ ID NO: 4293 - DNA, 16 bp, Artificial sequence
  Synthetic Oligonucleotide
gttttagatgcatgta

SEQ ID NO: 4294 - DNA, 16 bp, Artificial sequence
  Synthetic Oligonucleotide
tacagtgttttagatg

SEQ ID NO: 4295 - DNA, 16 bp, Artificial sequence
  Synthetic Oligonucleotide
ttccccgtaagtttat

SEQ ID NO: 4296 - DNA, 16 bp, Artificial sequence
  Synthetic Oligonucleotide
ctgtatttccccgtaa

SEQ ID NO: 4297 - DNA, 16 bp, Artificial sequence
  Synthetic Oligonucleotide
tagttactgttactgt

SEQ ID NO: 4298 - DNA, 16 bp, Artificial sequence
  Synthetic Oligonucleotide
cgtatgtagttactgt

SEQ ID NO: 4299 - DNA, 16 bp, Artificial sequence
  Synthetic Oligonucleotide
aatgggtacagactcg

SEQ ID NO: 4300 - DNA, 16 bp, Artificial sequence
  Synthetic Oligonucleotide
gcaatttaatgggtac

SEQ ID NO: 4301 - DNA, 16 bp, Artificial sequence
  Synthetic Oligonucleotide
gatagatatgcaattt

SEQ ID NO: 4302 - DNA, 16 bp, Artificial sequence
  Synthetic Oligonucleotide
aaaggagatagatatg

SEQ ID NO: 4303 - DNA, 16 bp, Artificial sequence
  Synthetic Oligonucleotide
cctcctaaaggagata

SEQ ID NO: 4304 - DNA, 16 bp, Artificial sequence
  Synthetic Oligonucleotide
caccagcctcctaaag

SEQ ID NO: 4305 - DNA, 16 bp, Artificial sequence
  Synthetic Oligonucleotide
tttgtgatcccaagta

SEQ ID NO: 4306 - DNA, 16 bp, Artificial sequence
  Synthetic Oligonucleotide
gctttgtgatcccaag

SEQ ID NO: 4307 - DNA, 16 bp, Artificial sequence
  Synthetic Oligonucleotide
ttgctttgtgatccca

SEQ ID NO: 4308 - DNA, 16 bp, Artificial sequence
  Synthetic Oligonucleotide
ttttgctttgtgatcc

SEQ ID NO: 4309 - DNA, 16 bp, Artificial sequence
  Synthetic Oligonucleotide
ccttttgctttgtgat

SEQ ID NO: 4310 - DNA, 16 bp, Artificial sequence
  Synthetic Oligonucleotide
gtccttttgctttgtg

SEQ ID NO: 4311 - DNA, 16 bp, Artificial sequence
  Synthetic Oligonucleotide
gtgtccttttgctttg

SEQ ID NO: 4312 - DNA, 16 bp, Artificial sequence
  Synthetic Oligonucleotide
gaagtgtccttttgct

SEQ ID NO: 4313 - DNA, 16 bp, Artificial sequence
  Synthetic Oligonucleotide
ttgaagtgtccttttg

SEQ ID NO: 4314 - DNA, 16 bp, Artificial sequence
  Synthetic Oligonucleotide
agttgaagtgtccttt

SEQ ID NO: 4315 - DNA, 16 bp, Artificial sequence
  Synthetic Oligonucleotide
acagttgaagtgtcct

SEQ ID NO: 4316 - DNA, 16 bp, Artificial sequence
  Synthetic Oligonucleotide
ggacagttgaagtgtc

SEQ ID NO: 4317 - DNA, 16 bp, Artificial sequence
  Synthetic Oligonucleotide
ctggacagttgaagtg

SEQ ID NO: 4318 - DNA, 16 bp, Artificial sequence
  Synthetic Oligonucleotide
ctctggacagttgaag

SEQ ID NO: 4319 - DNA, 16 bp, Artificial sequence
  Synthetic Oligonucleotide
ccctctggacagttga

SEQ ID NO: 4320 - DNA, 16 bp, Artificial sequence
  Synthetic Oligonucleotide
aaccctctggacagtt

SEQ ID NO: 4321 - DNA, 16 bp, Artificial sequence
  Synthetic Oligonucleotide
ataaccctctggacag

SEQ ID NO: 4322 - DNA, 16 bp, Artificial sequence
  Synthetic Oligonucleotide
gaataaccctctggac

SEQ ID NO: 4323 - DNA, 16 bp, Artificial sequence
  Synthetic Oligonucleotide
ctgaataaccctctgg

SEQ ID NO: 4324 - DNA, 16 bp, Artificial sequence
  Synthetic Oligonucleotide
tcctgaataaccctct

SEQ ID NO: 4325 - DNA, 16 bp, Artificial sequence
  Synthetic Oligonucleotide
cctcctgaataaccct

SEQ ID NO: 4326 - DNA, 16 bp, Artificial sequence
  Synthetic Oligonucleotide
accaccagcctcctga

SEQ ID NO: 4327 - DNA, 16 bp, Artificial sequence
  Synthetic Oligonucleotide
atgccaccaccagcct

SEQ ID NO: 4328 - DNA, 16 bp, Artificial sequence
  Synthetic Oligonucleotide
tcatgccaccaccagc

SEQ ID NO: 4329 - DNA, 16 bp, Artificial sequence
  Synthetic Oligonucleotide
catcatgccaccacca

SEQ ID NO: 4330 - DNA, 16 bp, Artificial sequence
  Synthetic Oligonucleotide
cactcatcatgccacc

SEQ ID NO: 4331 - DNA, 16 bp, Artificial sequence
  Synthetic Oligonucleotide
tccacactcatcatgc

SEQ ID NO: 4332 - DNA, 16 bp, Artificial sequence
  Synthetic Oligonucleotide
tctccacactcatcat

SEQ ID NO: 4333 - DNA, 16 bp, Artificial sequence
  Synthetic Oligonucleotide
tttctccacactcatc

SEQ ID NO: 4334 - DNA, 16 bp, Artificial sequence
  Synthetic Oligonucleotide
gttttctccacactca

SEQ ID NO: 4335 - DNA, 16 bp, Artificial sequence
  Synthetic Oligonucleotide
gttgttttctccacac

SEQ ID NO: 4336 - DNA, 16 bp, Artificial sequence
  Synthetic Oligonucleotide
aggttgttttctccac

SEQ ID NO: 4337 - DNA, 16 bp, Artificial sequence
  Synthetic Oligonucleotide
ttaggttgttttctcc

SEQ ID NO: 4338 - DNA, 16 bp, Artificial sequence
  Synthetic Oligonucleotide
taccatttaggttgtt

SEQ ID NO: 4339 - DNA, 16 bp, Artificial sequence
  Synthetic Oligonucleotide
tttaccatttaggttg

SEQ ID NO: 4340 - DNA, 16 bp, Artificial sequence
  Synthetic Oligonucleotide
tatttaccatttaggt

SEQ ID NO: 4341 - DNA, 16 bp, Artificial sequence
  Synthetic Oligonucleotide
ttgttatatttaccat

SEQ ID NO: 4342 - DNA, 16 bp, Artificial sequence
  Synthetic Oligonucleotide
gtttgttatatttacc

SEQ ID NO: 4343 - DNA, 16 bp, Artificial sequence
  Synthetic Oligonucleotide
cttggtttgttatatt

SEQ ID NO: 4344 - DNA, 16 bp, Artificial sequence
  Synthetic Oligonucleotide
ctcttggtttgttata

SEQ ID NO: 4345 - DNA, 16 bp, Artificial sequence
  Synthetic Oligonucleotide
tgctcttggtttgtta

SEQ ID NO: 4346 - DNA, 16 bp, Artificial sequence
  Synthetic Oligonucleotide
tttgctcttggtttgt

SEQ ID NO: 4347 - DNA, 16 bp, Artificial sequence
  Synthetic Oligonucleotide
gattttgctcttggtt

SEQ ID NO: 4348 - DNA, 16 bp, Artificial sequence
  Synthetic Oligonucleotide
cttagattttgctctt

SEQ ID NO: 4349 - DNA, 16 bp, Artificial sequence
  Synthetic Oligonucleotide
ggcttagattttgctc

SEQ ID NO: 4350 - DNA, 16 bp, Artificial sequence
  Synthetic Oligonucleotide
ctggcttagattttgc

SEQ ID NO: 4351 - DNA, 16 bp, Artificial sequence
  Synthetic Oligonucleotide
ctctggcttagatttt

SEQ ID NO: 4352 - DNA, 16 bp, Artificial sequence
  Synthetic Oligonucleotide
ctctctggcttagatt

SEQ ID NO: 4353 - DNA, 16 bp, Artificial sequence
  Synthetic Oligonucleotide
tcctctctggcttaga

SEQ ID NO: 4354 - DNA, 16 bp, Artificial sequence
  Synthetic Oligonucleotide
tctcctctctggctta

SEQ ID NO: 4355 - DNA, 16 bp, Artificial sequence
  Synthetic Oligonucleotide
taatcctcttctcctc

SEQ ID NO: 4356 - DNA, 16 bp, Artificial sequence
  Synthetic Oligonucleotide
gataatcctcttctcc

SEQ ID NO: 4357 - DNA, 16 bp, Artificial sequence
  Synthetic Oligonucleotide
aagataatcctcttct

SEQ ID NO: 4358 - DNA, 16 bp, Artificial sequence
  Synthetic Oligonucleotide
ccaagataatcctctt

SEQ ID NO: 4359 - DNA, 16 bp, Artificial sequence
  Synthetic Oligonucleotide
ttccaagataatcctc

SEQ ID NO: 4360 - DNA, 16 bp, Artificial sequence
  Synthetic Oligonucleotide
acttccaagataatcc

SEQ ID NO: 4361 - DNA, 16 bp, Artificial sequence
  Synthetic Oligonucleotide
agacttccaagataat

SEQ ID NO: 4362 - DNA, 16 bp, Artificial sequence
  Synthetic Oligonucleotide
tgagacttccaagata

SEQ ID NO: 4363 - DNA, 16 bp, Artificial sequence
  Synthetic Oligonucleotide
tttgagacttccaaga

SEQ ID NO: 4364 - DNA, 16 bp, Artificial sequence
  Synthetic Oligonucleotide
attttgagacttccaa

SEQ ID NO: 4365 - DNA, 16 bp, Artificial sequence
  Synthetic Oligonucleotide
ttccattttgagactt

SEQ ID NO: 4366 - DNA, 16 bp, Artificial sequence
  Synthetic Oligonucleotide
ccttccattttgagac

SEQ ID NO: 4367 - DNA, 16 bp, Artificial sequence
  Synthetic Oligonucleotide
aaccttccattttgag

SEQ ID NO: 4368 - DNA, 16 bp, Artificial sequence
  Synthetic Oligonucleotide
ataaccttccattttg

SEQ ID NO: 4369 - DNA, 16 bp, Artificial sequence
  Synthetic Oligonucleotide
gtataaccttccattt

SEQ ID NO: 4370 - DNA, 16 bp, Artificial sequence
  Synthetic Oligonucleotide
gagtataaccttccat

SEQ ID NO: 4371 - DNA, 16 bp, Artificial sequence
  Synthetic Oligonucleotide
tatagagtataacctt

SEQ ID NO: 4372 - DNA, 16 bp, Artificial sequence
  Synthetic Oligonucleotide
tttatagagtataacc

SEQ ID NO: 4373 - DNA, 16 bp, Artificial sequence
  Synthetic Oligonucleotide
gattttatagagtata

SEQ ID NO: 4374 - DNA, 16 bp, Artificial sequence
  Synthetic Oligonucleotide
ttgattttatagagta

SEQ ID NO: 4375 - DNA, 16 bp, Artificial sequence
  Synthetic Oligonucleotide
ggttgattttatagag

SEQ ID NO: 4376 - DNA, 16 bp, Artificial sequence
  Synthetic Oligonucleotide
ttggttgattttatag

SEQ ID NO: 4377 - DNA, 20 bp, Artificial sequence
  Synthetic Oligonucleotide
taatgtttaaattattgcct

SEQ ID NO: 4378 - DNA, 20 bp, Artificial sequence
  Synthetic Oligonucleotide
ggttaatgtttaaattattg

SEQ ID NO: 4379 - DNA, 20 bp, Artificial sequence
  Synthetic Oligonucleotide
aggttaatgtttaaattatt

SEQ ID NO: 4380 - DNA, 20 bp, Artificial sequence
  Synthetic Oligonucleotide
gaggttaatgtttaaattat

SEQ ID NO: 4381 - DNA, 20 bp, Artificial sequence
  Synthetic Oligonucleotide
tgaggttaatgtttaaatta

SEQ ID NO: 4382 - DNA, 20 bp, Artificial sequence
  Synthetic Oligonucleotide
aatgaggttaatgtttaaat

SEQ ID NO: 4383 - DNA, 20 bp, Artificial sequence
  Synthetic Oligonucleotide
gaatgaggttaatgtttaaa

SEQ ID NO: 4384 - DNA, 20 bp, Artificial sequence
  Synthetic Oligonucleotide
ggaatgaggttaatgtttaa

SEQ ID NO: 4385 - DNA, 20 bp, Artificial sequence
  Synthetic Oligonucleotide
tggaatgaggttaatgttta

SEQ ID NO: 4386 - DNA, 20 bp, Artificial sequence
  Synthetic Oligonucleotide
ttggaatgaggttaatgttt

SEQ ID NO: 4387 - DNA, 20 bp, Artificial sequence
  Synthetic Oligonucleotide
cttggaatgaggttaatgtt

SEQ ID NO: 4388 - DNA, 20 bp, Artificial sequence
  Synthetic Oligonucleotide
taacttggaatgaggttaat

SEQ ID NO: 4389 - DNA, 20 bp, Artificial sequence
  Synthetic Oligonucleotide
ttaacttggaatgaggttaa

SEQ ID NO: 4390 - DNA, 20 bp, Artificial sequence
  Synthetic Oligonucleotide
attaacttggaatgaggtta

SEQ ID NO: 4391 - DNA, 20 bp, Artificial sequence
  Synthetic Oligonucleotide
cattaacttggaatgaggtt

SEQ ID NO: 4392 - DNA, 20 bp, Artificial sequence
  Synthetic Oligonucleotide
acattaacttggaatgaggt

SEQ ID NO: 4393 - DNA, 20 bp, Artificial sequence
  Synthetic Oligonucleotide
accacattaacttggaatga

SEQ ID NO: 4394 - DNA, 20 bp, Artificial sequence
  Synthetic Oligonucleotide
gaccacattaacttggaatg

SEQ ID NO: 4395 - DNA, 20 bp, Artificial sequence
  Synthetic Oligonucleotide
agaccacattaacttggaat

SEQ ID NO: 4396 - DNA, 20 bp, Artificial sequence
  Synthetic Oligonucleotide
tagaccacattaacttggaa

SEQ ID NO: 4397 - DNA, 20 bp, Artificial sequence
  Synthetic Oligonucleotide
ttagaccacattaacttgga

SEQ ID NO: 4398 - DNA, 20 bp, Artificial sequence
  Synthetic Oligonucleotide
attagaccacattaacttgg

SEQ ID NO: 4399 - DNA, 20 bp, Artificial sequence
  Synthetic Oligonucleotide
tattagaccacattaacttg

SEQ ID NO: 4400 - DNA, 20 bp, Artificial sequence
  Synthetic Oligonucleotide
ttattagaccacattaactt

SEQ ID NO: 4401 - DNA, 20 bp, Artificial sequence
  Synthetic Oligonucleotide
attattagaccacattaact

SEQ ID NO: 4402 - DNA, 20 bp, Artificial sequence
  Synthetic Oligonucleotide
gattattagaccacattaac

SEQ ID NO: 4403 - DNA, 20 bp, Artificial sequence
  Synthetic Oligonucleotide
aataccagattattagacca

SEQ ID NO: 4404 - DNA, 20 bp, Artificial sequence
  Synthetic Oligonucleotide
taataccagattattagacc

SEQ ID NO: 4405 - DNA, 20 bp, Artificial sequence
  Synthetic Oligonucleotide
tttaataccagattattaga

SEQ ID NO: 4406 - DNA, 20 bp, Artificial sequence
  Synthetic Oligonucleotide
atttaataccagattattag

SEQ ID NO: 4407 - DNA, 20 bp, Artificial sequence
  Synthetic Oligonucleotide
gatttaataccagattatta

SEQ ID NO: 4408 - DNA, 20 bp, Artificial sequence
  Synthetic Oligonucleotide
taaggatttaataccagatt

SEQ ID NO: 4409 - DNA, 20 bp, Artificial sequence
  Synthetic Oligonucleotide
tttctcttaaggatttaata

SEQ ID NO: 4410 - DNA, 20 bp, Artificial sequence
  Synthetic Oligonucleotide
ctttctcttaaggatttaat

SEQ ID NO: 4411 - DNA, 20 bp, Artificial sequence
  Synthetic Oligonucleotide
agctttctcttaaggattta

SEQ ID NO: 4412 - DNA, 20 bp, Artificial sequence
  Synthetic Oligonucleotide
aagctttctcttaaggattt

SEQ ID NO: 4413 - DNA, 20 bp, Artificial sequence
  Synthetic Oligonucleotide
tcaagctttctcttaaggat

SEQ ID NO: 4414 - DNA, 20 bp, Artificial sequence
  Synthetic Oligonucleotide
ttctcaagctttctcttaag

SEQ ID NO: 4415 - DNA, 20 bp, Artificial sequence
  Synthetic Oligonucleotide
tttctcaagctttctcttaa

SEQ ID NO: 4416 - DNA, 20 bp, Artificial sequence
  Synthetic Oligonucleotide
tctatttctcaagctttctc

SEQ ID NO: 4417 - DNA, 20 bp, Artificial sequence
  Synthetic Oligonucleotide
atctatttctcaagctttct

SEQ ID NO: 4418 - DNA, 20 bp, Artificial sequence
  Synthetic Oligonucleotide
aatctatttctcaagctttc

SEQ ID NO: 4419 - DNA, 20 bp, Artificial sequence
  Synthetic Oligonucleotide
aaatctatttctcaagcttt

SEQ ID NO: 4420 - DNA, 20 bp, Artificial sequence
  Synthetic Oligonucleotide
aaaatctatttctcaagctt

SEQ ID NO: 4421 - DNA, 20 bp, Artificial sequence
  Synthetic Oligonucleotide
gataaaaaaaatctatttct

SEQ ID NO: 4422 - DNA, 20 bp, Artificial sequence
  Synthetic Oligonucleotide
tagacagtgactttaagata

SEQ ID NO: 4423 - DNA, 20 bp, Artificial sequence
  Synthetic Oligonucleotide
atagacagtgactttaagat

SEQ ID NO: 4424 - DNA, 20 bp, Artificial sequence
  Synthetic Oligonucleotide
aatagacagtgactttaaga

SEQ ID NO: 4425 - DNA, 20 bp, Artificial sequence
  Synthetic Oligonucleotide
aaatagacagtgactttaag

SEQ ID NO: 4426 - DNA, 20 bp, Artificial sequence
  Synthetic Oligonucleotide
taaatagacagtgactttaa

SEQ ID NO: 4427 - DNA, 20 bp, Artificial sequence
  Synthetic Oligonucleotide
ttaaatagacagtgacttta

SEQ ID NO: 4428 - DNA, 20 bp, Artificial sequence
  Synthetic Oligonucleotide
cttaaatagacagtgacttt

SEQ ID NO: 4429 - DNA, 20 bp, Artificial sequence
  Synthetic Oligonucleotide
tcttaaatagacagtgactt

SEQ ID NO: 4430 - DNA, 20 bp, Artificial sequence
  Synthetic Oligonucleotide
atcttaaatagacagtgact

SEQ ID NO: 4431 - DNA, 20 bp, Artificial sequence
  Synthetic Oligonucleotide
aatcttaaatagacagtgac

SEQ ID NO: 4432 - DNA, 20 bp, Artificial sequence
  Synthetic Oligonucleotide
taatcttaaatagacagtga

SEQ ID NO: 4433 - DNA, 20 bp, Artificial sequence
  Synthetic Oligonucleotide
ttaatcttaaatagacagtg

SEQ ID NO: 4434 - DNA, 20 bp, Artificial sequence
  Synthetic Oligonucleotide
tttaatcttaaatagacagt

SEQ ID NO: 4435 - DNA, 20 bp, Artificial sequence
  Synthetic Oligonucleotide
gtttaatcttaaatagacag

SEQ ID NO: 4436 - DNA, 20 bp, Artificial sequence
  Synthetic Oligonucleotide
tgtttaatcttaaatagaca

SEQ ID NO: 4437 - DNA, 20 bp, Artificial sequence
  Synthetic Oligonucleotide
atgtttaatcttaaatagac

SEQ ID NO: 4438 - DNA, 20 bp, Artificial sequence
  Synthetic Oligonucleotide
ttgtatgtttaatcttaaat

SEQ ID NO: 4439 - DNA, 20 bp, Artificial sequence
  Synthetic Oligonucleotide
attgtatgtttaatcttaaa

SEQ ID NO: 4440 - DNA, 20 bp, Artificial sequence
  Synthetic Oligonucleotide
gattgtatgtttaatcttaa

SEQ ID NO: 4441 - DNA, 20 bp, Artificial sequence
  Synthetic Oligonucleotide
tgattgtatgtttaatctta

SEQ ID NO: 4442 - DNA, 20 bp, Artificial sequence
  Synthetic Oligonucleotide
tatgtgattgtatgtttaat

SEQ ID NO: 4443 - DNA, 20 bp, Artificial sequence
  Synthetic Oligonucleotide
gttatgtgattgtatgttta

SEQ ID NO: 4444 - DNA, 20 bp, Artificial sequence
  Synthetic Oligonucleotide
taaggttatgtgattgtatg

SEQ ID NO: 4445 - DNA, 20 bp, Artificial sequence
  Synthetic Oligonucleotide
ttaaggttatgtgattgtat

SEQ ID NO: 4446 - DNA, 20 bp, Artificial sequence
  Synthetic Oligonucleotide
ttctttaaggttatgtgatt

SEQ ID NO: 4447 - DNA, 16 bp, Artificial sequence
  Synthetic Oligonucleotide
gaaatgtaaacggtat

SEQ ID NO: 4448 - DNA, 16 bp, Artificial sequence
  Synthetic Oligonucleotide
ttgagaaatgtaaacg

SEQ ID NO: 4449 - DNA, 16 bp, Artificial sequence
  Synthetic Oligonucleotide
tgattgagaaatgtaa

SEQ ID NO: 4450 - DNA, 16 bp, Artificial sequence
  Synthetic Oligonucleotide
tttgattgagaaatgt

SEQ ID NO: 4451 - DNA, 16 bp, Artificial sequence
  Synthetic Oligonucleotide
aagaattttgattgag

SEQ ID NO: 4452 - DNA, 16 bp, Artificial sequence
  Synthetic Oligonucleotide
ataagaattttgattg

SEQ ID NO: 4453 - DNA, 16 bp, Artificial sequence
  Synthetic Oligonucleotide
caaatagtattataag

SEQ ID NO: 4454 - DNA, 16 bp, Artificial sequence
  Synthetic Oligonucleotide
cccacatcacaaaatt

SEQ ID NO: 4455 - DNA, 16 bp, Artificial sequence
  Synthetic Oligonucleotide
gattcccacatcacaa

SEQ ID NO: 4456 - DNA, 16 bp, Artificial sequence
  Synthetic Oligonucleotide
ttgattcccacatcac

SEQ ID NO: 4457 - DNA, 16 bp, Artificial sequence
  Synthetic Oligonucleotide
aattgattcccacatc

SEQ ID NO: 4458 - DNA, 16 bp, Artificial sequence
  Synthetic Oligonucleotide
aaaattgattcccaca

SEQ ID NO: 4459 - DNA, 16 bp, Artificial sequence
  Synthetic Oligonucleotide
ctaaaattgattccca

SEQ ID NO: 4460 - DNA, 16 bp, Artificial sequence
  Synthetic Oligonucleotide
catctaaaattgattc

SEQ ID NO: 4461 - DNA, 16 bp, Artificial sequence
  Synthetic Oligonucleotide
accatctaaaattgat

SEQ ID NO: 4462 - DNA, 16 bp, Artificial sequence
  Synthetic Oligonucleotide
tgaccatctaaaattg

SEQ ID NO: 4463 - DNA, 16 bp, Artificial sequence
  Synthetic Oligonucleotide
tgtgaccatctaaaat

SEQ ID NO: 4464 - DNA, 16 bp, Artificial sequence
  Synthetic Oligonucleotide
attgtgaccatctaaa

SEQ ID NO: 4465 - DNA, 16 bp, Artificial sequence
  Synthetic Oligonucleotide
agattgtgaccatcta

SEQ ID NO: 4466 - DNA, 16 bp, Artificial sequence
  Synthetic Oligonucleotide
ctagattgtgaccatc

SEQ ID NO: 4467 - DNA, 16 bp, Artificial sequence
  Synthetic Oligonucleotide
atctagattgtgacca

SEQ ID NO: 4468 - DNA, 16 bp, Artificial sequence
  Synthetic Oligonucleotide
taatctagattgtgac

SEQ ID NO: 4469 - DNA, 16 bp, Artificial sequence
  Synthetic Oligonucleotide
tataatctagattgtg

SEQ ID NO: 4470 - DNA, 16 bp, Artificial sequence
  Synthetic Oligonucleotide
attataatctagattg

SEQ ID NO: 4471 - DNA, 16 bp, Artificial sequence
  Synthetic Oligonucleotide
tgattataatctagat

SEQ ID NO: 4472 - DNA, 16 bp, Artificial sequence
  Synthetic Oligonucleotide
attgattataatctag

SEQ ID NO: 4473 - DNA, 16 bp, Artificial sequence
  Synthetic Oligonucleotide
ctattgattataatct

SEQ ID NO: 4474 - DNA, 16 bp, Artificial sequence
  Synthetic Oligonucleotide
acctattgattataat

SEQ ID NO: 4475 - DNA, 16 bp, Artificial sequence
  Synthetic Oligonucleotide
tcacctattgattata

SEQ ID NO: 4476 - DNA, 16 bp, Artificial sequence
  Synthetic Oligonucleotide
gttcacctattgatta

SEQ ID NO: 4477 - DNA, 16 bp, Artificial sequence
  Synthetic Oligonucleotide
aagttcacctattgat

SEQ ID NO: 4478 - DNA, 16 bp, Artificial sequence
  Synthetic Oligonucleotide
ataagttcacctattg

SEQ ID NO: 4479 - DNA, 16 bp, Artificial sequence
  Synthetic Oligonucleotide
taataagttcacctat

SEQ ID NO: 4480 - DNA, 16 bp, Artificial sequence
  Synthetic Oligonucleotide
tttaataagttcacct

SEQ ID NO: 4481 - DNA, 16 bp, Artificial sequence
  Synthetic Oligonucleotide
tatttaataagttcac

SEQ ID NO: 4482 - DNA, 16 bp, Artificial sequence
  Synthetic Oligonucleotide
gttatttaataagttc

SEQ ID NO: 4483 - DNA, 16 bp, Artificial sequence
  Synthetic Oligonucleotide
catatgatgcctttta

SEQ ID NO: 4484 - DNA, 16 bp, Artificial sequence
  Synthetic Oligonucleotide
tattagctcatatgat

SEQ ID NO: 4485 - DNA, 16 bp, Artificial sequence
  Synthetic Oligonucleotide
gatattagctcatatg

SEQ ID NO: 4486 - DNA, 16 bp, Artificial sequence
  Synthetic Oligonucleotide
gtgatattagctcata

SEQ ID NO: 4487 - DNA, 16 bp, Artificial sequence
  Synthetic Oligonucleotide
agttgtgatattagct

SEQ ID NO: 4488 - DNA, 16 bp, Artificial sequence
  Synthetic Oligonucleotide
aaagttgtgatattag

SEQ ID NO: 4489 - DNA, 16 bp, Artificial sequence
  Synthetic Oligonucleotide
ggaaagttgtgatatt

SEQ ID NO: 4490 - DNA, 16 bp, Artificial sequence
  Synthetic Oligonucleotide
tgggaaagttgtgata

SEQ ID NO: 4491 - DNA, 16 bp, Artificial sequence
  Synthetic Oligonucleotide
aaactgggaaagttgt

SEQ ID NO: 4492 - DNA, 16 bp, Artificial sequence
  Synthetic Oligonucleotide
ttaaactgggaaagtt

SEQ ID NO: 4493 - DNA, 16 bp, Artificial sequence
  Synthetic Oligonucleotide
gttttttaaactggga

SEQ ID NO: 4494 - DNA, 16 bp, Artificial sequence
  Synthetic Oligonucleotide
tagttttttaaactgg

SEQ ID NO: 4495 - DNA, 16 bp, Artificial sequence
  Synthetic Oligonucleotide
gagtactagtttttta

SEQ ID NO: 4496 - DNA, 16 bp, Artificial sequence
  Synthetic Oligonucleotide
aagagtactagttttt

SEQ ID NO: 4497 - DNA, 16 bp, Artificial sequence
  Synthetic Oligonucleotide
acaagagtactagttt

SEQ ID NO: 4498 - DNA, 16 bp, Artificial sequence
  Synthetic Oligonucleotide
taacaagagtactagt

SEQ ID NO: 4499 - DNA, 16 bp, Artificial sequence
  Synthetic Oligonucleotide
tttaacaagagtacta

SEQ ID NO: 4500 - DNA, 16 bp, Artificial sequence
  Synthetic Oligonucleotide
gttttaacaagagtac

SEQ ID NO: 4501 - DNA, 16 bp, Artificial sequence
  Synthetic Oligonucleotide
gagttttaacaagagt

SEQ ID NO: 4502 - DNA, 16 bp, Artificial sequence
  Synthetic Oligonucleotide
tagagttttaacaaga

SEQ ID NO: 4503 - DNA, 16 bp, Artificial sequence
  Synthetic Oligonucleotide
gtttagagttttaaca

SEQ ID NO: 4504 - DNA, 16 bp, Artificial sequence
  Synthetic Oligonucleotide
caagtttagagtttta

SEQ ID NO: 4505 - DNA, 16 bp, Artificial sequence
  Synthetic Oligonucleotide
gtcaagtttagagttt

SEQ ID NO: 4506 - DNA, 16 bp, Artificial sequence
  Synthetic Oligonucleotide
tagtcaagtttagagt

SEQ ID NO: 4507 - DNA, 16 bp, Artificial sequence
  Synthetic Oligonucleotide
tttagtcaagtttaga

SEQ ID NO: 4508 - DNA, 16 bp, Artificial sequence
  Synthetic Oligonucleotide
tatttagtcaagttta

SEQ ID NO: 4509 - DNA, 16 bp, Artificial sequence
  Synthetic Oligonucleotide
tgtatttagtcaagtt

SEQ ID NO: 4510 - DNA, 16 bp, Artificial sequence
  Synthetic Oligonucleotide
tctgtatttagtcaag

SEQ ID NO: 4511 - DNA, 16 bp, Artificial sequence
  Synthetic Oligonucleotide
cctctgtatttagtca

SEQ ID NO: 4512 - DNA, 16 bp, Artificial sequence
  Synthetic Oligonucleotide
gtcctctgtatttagt

SEQ ID NO: 4513 - DNA, 16 bp, Artificial sequence
  Synthetic Oligonucleotide
cagtcctctgtattta

SEQ ID NO: 4514 - DNA, 16 bp, Artificial sequence
  Synthetic Oligonucleotide
accagtcctctgtatt

SEQ ID NO: 4515 - DNA, 16 bp, Artificial sequence
  Synthetic Oligonucleotide
ttaccagtcctctgta

SEQ ID NO: 4516 - DNA, 16 bp, Artificial sequence
  Synthetic Oligonucleotide
aattaccagtcctctg

SEQ ID NO: 4517 - DNA, 16 bp, Artificial sequence
  Synthetic Oligonucleotide
acaattaccagtcctc

SEQ ID NO: 4518 - DNA, 16 bp, Artificial sequence
  Synthetic Oligonucleotide
gcaaattttcagtgtt

SEQ ID NO: 4519 - DNA, 16 bp, Artificial sequence
  Synthetic Oligonucleotide
cgatttgtaattttca

SEQ ID NO: 4520 - DNA, 16 bp, Artificial sequence
  Synthetic Oligonucleotide
tttaaccgatttgtaa

SEQ ID NO: 4521 - DNA, 16 bp, Artificial sequence
  Synthetic Oligonucleotide
gtataatttaaccgat

SEQ ID NO: 4522 - DNA, 16 bp, Artificial sequence
  Synthetic Oligonucleotide
ctagattgtataattt

SEQ ID NO: 4523 - DNA, 16 bp, Artificial sequence
  Synthetic Oligonucleotide
agtgttctagattgta

SEQ ID NO: 4524 - DNA, 16 bp, Artificial sequence
  Synthetic Oligonucleotide
tgacatagtgttctag

SEQ ID NO: 4525 - DNA, 16 bp, Artificial sequence
  Synthetic Oligonucleotide
gtgtaatgacatagtg

SEQ ID NO: 4526 - DNA, 16 bp, Artificial sequence
  Synthetic Oligonucleotide
acaatagtgtaatgac

SEQ ID NO: 4527 - DNA, 16 bp, Artificial sequence
  Synthetic Oligonucleotide
gtaatttacaatagtg

SEQ ID NO: 4528 - DNA, 16 bp, Artificial sequence
  Synthetic Oligonucleotide
ccttcagtaatttaca

SEQ ID NO: 4529 - DNA, 16 bp, Artificial sequence
  Synthetic Oligonucleotide
tacttaccttcagtaa

SEQ ID NO: 4530 - DNA, 16 bp, Artificial sequence
  Synthetic Oligonucleotide
ctggagaatagtttta

SEQ ID NO: 4531 - DNA, 16 bp, Artificial sequence
  Synthetic Oligonucleotide
ttaaacactggagaat

SEQ ID NO: 4532 - DNA, 16 bp, Artificial sequence
  Synthetic Oligonucleotide
gcccagcatattttca

SEQ ID NO: 4533 - DNA, 16 bp, Artificial sequence
  Synthetic Oligonucleotide
gaaaaagcccagcata

SEQ ID NO: 4534 - DNA, 16 bp, Artificial sequence
  Synthetic Oligonucleotide
gattttctgaacttca

SEQ ID NO: 4535 - DNA, 16 bp, Artificial sequence
  Synthetic Oligonucleotide
gtactatctctaaaat

SEQ ID NO: 4536 - DNA, 16 bp, Artificial sequence
  Synthetic Oligonucleotide
taaattgtactatctc

SEQ ID NO: 4537 - DNA, 16 bp, Artificial sequence
  Synthetic Oligonucleotide
cacatatttttgtcct

SEQ ID NO: 4538 - DNA, 16 bp, Artificial sequence
  Synthetic Oligonucleotide
ctttcaaatagcacat

SEQ ID NO: 4539 - DNA, 16 bp, Artificial sequence
  Synthetic Oligonucleotide
gtatgcttctttcaaa

SEQ ID NO: 4540 - DNA, 16 bp, Artificial sequence
  Synthetic Oligonucleotide
ccccttgtatgcttct

SEQ ID NO: 4541 - DNA, 16 bp, Artificial sequence
  Synthetic Oligonucleotide
ttccttccccttgtat

SEQ ID NO: 4542 - DNA, 16 bp, Artificial sequence
  Synthetic Oligonucleotide
tggcaattccttcccc

SEQ ID NO: 4543 - DNA, 16 bp, Artificial sequence
  Synthetic Oligonucleotide
gaatattggcaattcc

SEQ ID NO: 4544 - DNA, 16 bp, Artificial sequence
  Synthetic Oligonucleotide
ctaataatggatttga

SEQ ID NO: 4545 - DNA, 16 bp, Artificial sequence
  Synthetic Oligonucleotide
ctatcataatctaaat

SEQ ID NO: 4546 - DNA, 16 bp, Artificial sequence
  Synthetic Oligonucleotide
gtaacactatcataat

SEQ ID NO: 4547 - DNA, 16 bp, Artificial sequence
  Synthetic Oligonucleotide
aatttcctgtaacact

SEQ ID NO: 4548 - DNA, 16 bp, Artificial sequence
  Synthetic Oligonucleotide
aagttgctttcctctt

SEQ ID NO: 4549 - DNA, 16 bp, Artificial sequence
  Synthetic Oligonucleotide
ggttataagttgcttt

SEQ ID NO: 4550 - DNA, 16 bp, Artificial sequence
  Synthetic Oligonucleotide
taggttggttataagt

SEQ ID NO: 4551 - DNA, 16 bp, Artificial sequence
  Synthetic Oligonucleotide
agagagtaggttggtt

SEQ ID NO: 4552 - DNA, 16 bp, Artificial sequence
  Synthetic Oligonucleotide
ggatatagagagtagg

SEQ ID NO: 4553 - DNA, 16 bp, Artificial sequence
  Synthetic Oligonucleotide
aagtctggatatagag

SEQ ID NO: 4554 - DNA, 16 bp, Artificial sequence
  Synthetic Oligonucleotide
ctacaaaagtctggat

SEQ ID NO: 4555 - DNA, 16 bp, Artificial sequence
  Synthetic Oligonucleotide
cttacctgattttcta

SEQ ID NO: 4556 - DNA, 16 bp, Artificial sequence
  Synthetic Oligonucleotide
tactgacttacctgat

SEQ ID NO: 4557 - DNA, 16 bp, Artificial sequence
  Synthetic Oligonucleotide
ccattaaaatactgac

SEQ ID NO: 4558 - DNA, 16 bp, Artificial sequence
  Synthetic Oligonucleotide
ggacataccattaaaa

SEQ ID NO: 4559 - DNA, 16 bp, Artificial sequence
  Synthetic Oligonucleotide
aagatgggacatacca

SEQ ID NO: 4560 - DNA, 16 bp, Artificial sequence
  Synthetic Oligonucleotide
gtgtgaaagatgggac

SEQ ID NO: 4561 - DNA, 16 bp, Artificial sequence
  Synthetic Oligonucleotide
agacctgtgtgaaaga

SEQ ID NO: 4562 - DNA, 16 bp, Artificial sequence
  Synthetic Oligonucleotide
ttttacagacctgtgt

SEQ ID NO: 4563 - DNA, 16 bp, Artificial sequence
  Synthetic Oligonucleotide
cagtgtttttacagac

SEQ ID NO: 4564 - DNA, 16 bp, Artificial sequence
  Synthetic Oligonucleotide
taggattcagtgtttt

SEQ ID NO: 4565 - DNA, 16 bp, Artificial sequence
  Synthetic Oligonucleotide
gttaaagcttgtaaat

SEQ ID NO: 4566 - DNA, 16 bp, Artificial sequence
  Synthetic Oligonucleotide
gatccagttaaagctt

SEQ ID NO: 4567 - DNA, 16 bp, Artificial sequence
  Synthetic Oligonucleotide
actcatgatccagtta

SEQ ID NO: 4568 - DNA, 16 bp, Artificial sequence
  Synthetic Oligonucleotide
aattttactcatgatc

SEQ ID NO: 4569 - DNA, 16 bp, Artificial sequence
  Synthetic Oligonucleotide
tgtgataattttactc

SEQ ID NO: 4570 - DNA, 16 bp, Artificial sequence
  Synthetic Oligonucleotide
tgctgatgtgataatt

SEQ ID NO: 4571 - DNA, 16 bp, Artificial sequence
  Synthetic Oligonucleotide
gcaattttaacagtta

SEQ ID NO: 4572 - DNA, 16 bp, Artificial sequence
  Synthetic Oligonucleotide
gagcctgcaattttaa

SEQ ID NO: 4573 - DNA, 16 bp, Artificial sequence
  Synthetic Oligonucleotide
tagcttcagagcctgc

SEQ ID NO: 4574 - DNA, 16 bp, Artificial sequence
  Synthetic Oligonucleotide
gtttattagcttcaga

SEQ ID NO: 4575 - DNA, 16 bp, Artificial sequence
  Synthetic Oligonucleotide
caggtagtttattagc

SEQ ID NO: 4576 - DNA, 16 bp, Artificial sequence
  Synthetic Oligonucleotide
taaatgcaggtagttt

SEQ ID NO: 4577 - DNA, 16 bp, Artificial sequence
  Synthetic Oligonucleotide
atggtttaaatgcagg

SEQ ID NO: 4578 - DNA, 16 bp, Artificial sequence
  Synthetic Oligonucleotide
tagagccatggtttaa

SEQ ID NO: 4579 - DNA, 16 bp, Artificial sequence
  Synthetic Oligonucleotide
tcacacaaagttttag

SEQ ID NO: 4580 - DNA, 16 bp, Artificial sequence
  Synthetic Oligonucleotide
gtgaagtaatttattc

SEQ ID NO: 4581 - DNA, 16 bp, Artificial sequence
  Synthetic Oligonucleotide
actgagagataaaggg

SEQ ID NO: 4582 - DNA, 16 bp, Artificial sequence
  Synthetic Oligonucleotide
gtatatgtgaggaaac

SEQ ID NO: 4583 - DNA, 16 bp, Artificial sequence
  Synthetic Oligonucleotide
tttgtagtatatgtga

SEQ ID NO: 4584 - DNA, 16 bp, Artificial sequence
  Synthetic Oligonucleotide
attatctttgtagtat

SEQ ID NO: 4585 - DNA, 16 bp, Artificial sequence
  Synthetic Oligonucleotide
ataagttctgttatta

SEQ ID NO: 4586 - DNA, 16 bp, Artificial sequence
  Synthetic Oligonucleotide
aatcctataagttctg

SEQ ID NO: 4587 - DNA, 16 bp, Artificial sequence
  Synthetic Oligonucleotide
ctgctatgaattaatt

SEQ ID NO: 4588 - DNA, 16 bp, Artificial sequence
  Synthetic Oligonucleotide
cattggctgctatgaa

SEQ ID NO: 4589 - DNA, 16 bp, Artificial sequence
  Synthetic Oligonucleotide
agatgacattggctgc

SEQ ID NO: 4590 - DNA, 16 bp, Artificial sequence
  Synthetic Oligonucleotide
ttagtaagatgacatt

SEQ ID NO: 4591 - DNA, 16 bp, Artificial sequence
  Synthetic Oligonucleotide
gatctaatttgaattt

SEQ ID NO: 4592 - DNA, 16 bp, Artificial sequence
  Synthetic Oligonucleotide
ttgagcaaagagaaac

SEQ ID NO: 4593 - DNA, 16 bp, Artificial sequence
  Synthetic Oligonucleotide
gaatgttgacctttaa

SEQ ID NO: 4594 - DNA, 16 bp, Artificial sequence
  Synthetic Oligonucleotide
attgttgaatgttgac

SEQ ID NO: 4595 - DNA, 16 bp, Artificial sequence
  Synthetic Oligonucleotide
ttaattacattgttga

SEQ ID NO: 4596 - DNA, 16 bp, Artificial sequence
  Synthetic Oligonucleotide
ttgtagattaattaca

SEQ ID NO: 4597 - DNA, 16 bp, Artificial sequence
  Synthetic Oligonucleotide
tttacattgtagatta

SEQ ID NO: 4598 - DNA, 16 bp, Artificial sequence
  Synthetic Oligonucleotide
cagatgtttacattgt

SEQ ID NO: 4599 - DNA, 16 bp, Artificial sequence
  Synthetic Oligonucleotide
cttcaccagatgttta

SEQ ID NO: 4600 - DNA, 16 bp, Artificial sequence
  Synthetic Oligonucleotide
agtgcttccctctgtc

SEQ ID NO: 4601 - DNA, 16 bp, Artificial sequence
  Synthetic Oligonucleotide
taaacaagtgcttccc

SEQ ID NO: 4602 - DNA, 16 bp, Artificial sequence
  Synthetic Oligonucleotide
tagcttttttctaaac

SEQ ID NO: 4603 - DNA, 16 bp, Artificial sequence
  Synthetic Oligonucleotide
ctgacatagctttttt

SEQ ID NO: 4604 - DNA, 16 bp, Artificial sequence
  Synthetic Oligonucleotide
aatacatggattctga

SEQ ID NO: 4605 - DNA, 16 bp, Artificial sequence
  Synthetic Oligonucleotide
tattagaatacatgga

SEQ ID NO: 4606 - DNA, 16 bp, Artificial sequence
  Synthetic Oligonucleotide
gtactgcatattagaa

SEQ ID NO: 4607 - DNA, 16 bp, Artificial sequence
  Synthetic Oligonucleotide
actattgtactgcata

SEQ ID NO: 4608 - DNA, 16 bp, Artificial sequence
  Synthetic Oligonucleotide
ttttaaactattgtac

SEQ ID NO: 4609 - DNA, 16 bp, Artificial sequence
  Synthetic Oligonucleotide
gagagtattattaata

SEQ ID NO: 4610 - DNA, 16 bp, Artificial sequence
  Synthetic Oligonucleotide
ctgtttgagagtatta

SEQ ID NO: 4611 - DNA, 16 bp, Artificial sequence
  Synthetic Oligonucleotide
gaatagctgtttgaga

SEQ ID NO: 4612 - DNA, 16 bp, Artificial sequence
  Synthetic Oligonucleotide
aatcctcttgaatagc

SEQ ID NO: 4613 - DNA, 16 bp, Artificial sequence
  Synthetic Oligonucleotide
tttttgaatcctcttg

SEQ ID NO: 4614 - DNA, 16 bp, Artificial sequence
  Synthetic Oligonucleotide
gagtttatattatgtt

SEQ ID NO: 4615 - DNA, 16 bp, Artificial sequence
  Synthetic Oligonucleotide
gtttctctgagtttat

SEQ ID NO: 4616 - DNA, 16 bp, Artificial sequence
  Synthetic Oligonucleotide
ttaccagtttctctga

SEQ ID NO: 4617 - DNA, 16 bp, Artificial sequence
  Synthetic Oligonucleotide
gattttgtttaccagt

SEQ ID NO: 4618 - DNA, 16 bp, Artificial sequence
  Synthetic Oligonucleotide
gttttatatctcttga

SEQ ID NO: 4619 - DNA, 16 bp, Artificial sequence
  Synthetic Oligonucleotide
ttggtaataatatttg

SEQ ID NO: 4620 - DNA, 16 bp, Artificial sequence
  Synthetic Oligonucleotide
tggaaattggtaataa

SEQ ID NO: 4621 - DNA, 16 bp, Artificial sequence
  Synthetic Oligonucleotide
gtttagtggaaattgg

SEQ ID NO: 4622 - DNA, 16 bp, Artificial sequence
  Synthetic Oligonucleotide
atgtttgtttagtgga

SEQ ID NO: 4623 - DNA, 16 bp, Artificial sequence
  Synthetic Oligonucleotide
ctaacattatgtttgt

SEQ ID NO: 4624 - DNA, 16 bp, Artificial sequence
  Synthetic Oligonucleotide
gcactactaacattat

SEQ ID NO: 4625 - DNA, 16 bp, Artificial sequence
  Synthetic Oligonucleotide
ttagcagcactactaa

SEQ ID NO: 4626 - DNA, 16 bp, Artificial sequence
  Synthetic Oligonucleotide
ttgataaaaaaccttt

SEQ ID NO: 4627 - DNA, 16 bp, Artificial sequence
  Synthetic Oligonucleotide
caaaagtagttgataa

SEQ ID NO: 4628 - DNA, 16 bp, Artificial sequence
  Synthetic Oligonucleotide
ggaaaccaaaagtagt

SEQ ID NO: 4629 - DNA, 16 bp, Artificial sequence
  Synthetic Oligonucleotide
gaaagtatggaaacca

SEQ ID NO: 4630 - DNA, 16 bp, Artificial sequence
  Synthetic Oligonucleotide
acatcataagaaggaa

SEQ ID NO: 4631 - DNA, 16 bp, Artificial sequence
  Synthetic Oligonucleotide
tcatagtaaaagatat

SEQ ID NO: 4632 - DNA, 16 bp, Artificial sequence
  Synthetic Oligonucleotide
tcatttaatcatagta

SEQ ID NO: 4633 - DNA, 16 bp, Artificial sequence
  Synthetic Oligonucleotide
gcaggttcatttaatc

SEQ ID NO: 4634 - DNA, 16 bp, Artificial sequence
  Synthetic Oligonucleotide
gtaacattttgctttg

SEQ ID NO: 4635 - DNA, 16 bp, Artificial sequence
  Synthetic Oligonucleotide
atattactatagtaac

SEQ ID NO: 4636 - DNA, 16 bp, Artificial sequence
  Synthetic Oligonucleotide
caatgtatattactat

SEQ ID NO: 4637 - DNA, 16 bp, Artificial sequence
  Synthetic Oligonucleotide
tagacacaatgtatat

SEQ ID NO: 4638 - DNA, 16 bp, Artificial sequence
  Synthetic Oligonucleotide
ggtttcttcacacatt

SEQ ID NO: 4639 - DNA, 16 bp, Artificial sequence
  Synthetic Oligonucleotide
ctcagaaattcattgt

SEQ ID NO: 4640 - DNA, 16 bp, Artificial sequence
  Synthetic Oligonucleotide
cttcttccaactcaga

SEQ ID NO: 4641 - DNA, 16 bp, Artificial sequence
  Synthetic Oligonucleotide
ctaactcttcttccaa

SEQ ID NO: 4642 - DNA, 16 bp, Artificial sequence
  Synthetic Oligonucleotide
aatgatctaactcttc

SEQ ID NO: 4643 - DNA, 16 bp, Artificial sequence
  Synthetic Oligonucleotide
gaaagttaaatgatct

SEQ ID NO: 4644 - DNA, 16 bp, Artificial sequence
  Synthetic Oligonucleotide
atcttaaagttactta

SEQ ID NO: 4645 - DNA, 16 bp, Artificial sequence
  Synthetic Oligonucleotide
tatgtgatcttaaagt

SEQ ID NO: 4646 - DNA, 16 bp, Artificial sequence
  Synthetic Oligonucleotide
agtaactatgtgatct

SEQ ID NO: 4647 - DNA, 16 bp, Artificial sequence
  Synthetic Oligonucleotide
ctactaagtaactatg

SEQ ID NO: 4648 - DNA, 16 bp, Artificial sequence
  Synthetic Oligonucleotide
tcttttctactaagta

SEQ ID NO: 4649 - DNA, 16 bp, Artificial sequence
  Synthetic Oligonucleotide
tattactcttttctac

SEQ ID NO: 4650 - DNA, 16 bp, Artificial sequence
  Synthetic Oligonucleotide
gctgggtattactctt

SEQ ID NO: 4651 - DNA, 16 bp, Artificial sequence
  Synthetic Oligonucleotide
taaagtttgcttgctg

SEQ ID NO: 4652 - DNA, 16 bp, Artificial sequence
  Synthetic Oligonucleotide
ctattgtaaagtttgc

SEQ ID NO: 4653 - DNA, 16 bp, Artificial sequence
  Synthetic Oligonucleotide
aaggatctattgtaaa

SEQ ID NO: 4654 - DNA, 16 bp, Artificial sequence
  Synthetic Oligonucleotide
cttatttaaaaggatc

SEQ ID NO: 4655 - DNA, 16 bp, Artificial sequence
  Synthetic Oligonucleotide
taggaccttatttaaa

SEQ ID NO: 4656 - DNA, 16 bp, Artificial sequence
  Synthetic Oligonucleotide
atttcctaggacctta

SEQ ID NO: 4657 - DNA, 16 bp, Artificial sequence
  Synthetic Oligonucleotide
catgaatgatatttcc

SEQ ID NO: 4658 - DNA, 16 bp, Artificial sequence
  Synthetic Oligonucleotide
tgctggcatgaatgat

SEQ ID NO: 4659 - DNA, 16 bp, Artificial sequence
  Synthetic Oligonucleotide
ttttgatgctggcatg

SEQ ID NO: 4660 - DNA, 16 bp, Artificial sequence
  Synthetic Oligonucleotide
ttagttttttgatgct

SEQ ID NO: 4661 - DNA, 16 bp, Artificial sequence
  Synthetic Oligonucleotide
gcattattagtgttag

SEQ ID NO: 4662 - DNA, 16 bp, Artificial sequence
  Synthetic Oligonucleotide
tatcttgcattattag

SEQ ID NO: 4663 - DNA, 16 bp, Artificial sequence
  Synthetic Oligonucleotide
atataatatcttgcat

SEQ ID NO: 4664 - DNA, 16 bp, Artificial sequence
  Synthetic Oligonucleotide
cattgacagtaagaaa

SEQ ID NO: 4665 - DNA, 16 bp, Artificial sequence
  Synthetic Oligonucleotide
agtttttctcattgac

SEQ ID NO: 4666 - DNA, 16 bp, Artificial sequence
  Synthetic Oligonucleotide
atggatatctcttaac

SEQ ID NO: 4667 - DNA, 16 bp, Artificial sequence
  Synthetic Oligonucleotide
tatttgatggatatct

SEQ ID NO: 4668 - DNA, 16 bp, Artificial sequence
  Synthetic Oligonucleotide
acattgtatttgatgg

SEQ ID NO: 4669 - DNA, 16 bp, Artificial sequence
  Synthetic Oligonucleotide
gttgatacattgtatt

SEQ ID NO: 4670 - DNA, 16 bp, Artificial sequence
  Synthetic Oligonucleotide
gtttaggttgatacat

SEQ ID NO: 4671 - DNA, 16 bp, Artificial sequence
  Synthetic Oligonucleotide
catccagtttaggttg

SEQ ID NO: 4672 - DNA, 16 bp, Artificial sequence
  Synthetic Oligonucleotide
ccccagcatccagttt

SEQ ID NO: 4673 - DNA, 16 bp, Artificial sequence
  Synthetic Oligonucleotide
aaagaaccccagcatc

SEQ ID NO: 4674 - DNA, 16 bp, Artificial sequence
  Synthetic Oligonucleotide
gtgtaaaaagaacccc

SEQ ID NO: 4675 - DNA, 16 bp, Artificial sequence
  Synthetic Oligonucleotide
tatagggtgtaaaaag

SEQ ID NO: 4676 - DNA, 16 bp, Artificial sequence
  Synthetic Oligonucleotide
aggtatgtcttttata

SEQ ID NO: 4677 - DNA, 16 bp, Artificial sequence
  Synthetic Oligonucleotide
agtccatatttgtatt

SEQ ID NO: 4678 - DNA, 16 bp, Artificial sequence
  Synthetic Oligonucleotide
taatcaagtccatatt

SEQ ID NO: 4679 - DNA, 16 bp, Artificial sequence
  Synthetic Oligonucleotide
atctaataatcaagtc

SEQ ID NO: 4680 - DNA, 16 bp, Artificial sequence
  Synthetic Oligonucleotide
ccttctatattatcta

SEQ ID NO: 4681 - DNA, 16 bp, Artificial sequence
  Synthetic Oligonucleotide
taataaaccttctata

SEQ ID NO: 4682 - DNA, 16 bp, Artificial sequence
  Synthetic Oligonucleotide
gatcacatctaagaaa

SEQ ID NO: 4683 - DNA, 16 bp, Artificial sequence
  Synthetic Oligonucleotide
taccatgatcacatct

SEQ ID NO: 4684 - DNA, 16 bp, Artificial sequence
  Synthetic Oligonucleotide
ctgcaataccatgatc

SEQ ID NO: 4685 - DNA, 16 bp, Artificial sequence
  Synthetic Oligonucleotide
gttctcctttaaaact

SEQ ID NO: 4686 - DNA, 16 bp, Artificial sequence
  Synthetic Oligonucleotide
gagattgttctccttt

SEQ ID NO: 4687 - DNA, 16 bp, Artificial sequence
  Synthetic Oligonucleotide
aaacaggagattgttc

SEQ ID NO: 4688 - DNA, 16 bp, Artificial sequence
  Synthetic Oligonucleotide
tctcttaaacaggaga

SEQ ID NO: 4689 - DNA, 16 bp, Artificial sequence
  Synthetic Oligonucleotide
catgtatctcttaaac

SEQ ID NO: 4690 - DNA, 16 bp, Artificial sequence
  Synthetic Oligonucleotide
cgtaaatatttcagca

SEQ ID NO: 4691 - DNA, 16 bp, Artificial sequence
  Synthetic Oligonucleotide
taactccgtaaatatt

SEQ ID NO: 4692 - DNA, 16 bp, Artificial sequence
  Synthetic Oligonucleotide
gacctttaactccgta

SEQ ID NO: 4693 - DNA, 16 bp, Artificial sequence
  Synthetic Oligonucleotide
tccagtgacctttaac

SEQ ID NO: 4694 - DNA, 16 bp, Artificial sequence
  Synthetic Oligonucleotide
caccagtctggagtcc

SEQ ID NO: 4695 - DNA, 16 bp, Artificial sequence
  Synthetic Oligonucleotide
ttctatcaccagtctg

SEQ ID NO: 4696 - DNA, 16 bp, Artificial sequence
  Synthetic Oligonucleotide
atcttaccaaactatt

SEQ ID NO: 4697 - DNA, 16 bp, Artificial sequence
  Synthetic Oligonucleotide
agaatcatcttaccaa

SEQ ID NO: 4698 - DNA, 16 bp, Artificial sequence
  Synthetic Oligonucleotide
gaatgtaagaatcatc

SEQ ID NO: 4699 - DNA, 16 bp, Artificial sequence
  Synthetic Oligonucleotide
gtgttatttaagaatg

SEQ ID NO: 4700 - DNA, 16 bp, Artificial sequence
  Synthetic Oligonucleotide
gtttatgttaaagcat

SEQ ID NO: 4701 - DNA, 16 bp, Artificial sequence
  Synthetic Oligonucleotide
agtaatgtttatgtta

SEQ ID NO: 4702 - DNA, 16 bp, Artificial sequence
  Synthetic Oligonucleotide
gtagcattttttcagt

SEQ ID NO: 4703 - DNA, 16 bp, Artificial sequence
  Synthetic Oligonucleotide
gcaaatgtagcatttt

SEQ ID NO: 4704 - DNA, 16 bp, Artificial sequence
  Synthetic Oligonucleotide
gttgtggcaaatgtag

SEQ ID NO: 4705 - DNA, 16 bp, Artificial sequence
  Synthetic Oligonucleotide
tatgaagttgtggcaa

SEQ ID NO: 4706 - DNA, 16 bp, Artificial sequence
  Synthetic Oligonucleotide
gatttcacttgacatt

SEQ ID NO: 4707 - DNA, 16 bp, Artificial sequence
  Synthetic Oligonucleotide
gcttgagatttcactt

SEQ ID NO: 4708 - DNA, 16 bp, Artificial sequence
  Synthetic Oligonucleotide
tttggagcttgagatt

SEQ ID NO: 4709 - DNA, 16 bp, Artificial sequence
  Synthetic Oligonucleotide
aatatctttggagctt

SEQ ID NO: 4710 - DNA, 16 bp, Artificial sequence
  Synthetic Oligonucleotide
aggaataatatctttg

SEQ ID NO: 4711 - DNA, 16 bp, Artificial sequence
  Synthetic Oligonucleotide
atttagtaataggaat

SEQ ID NO: 4712 - DNA, 16 bp, Artificial sequence
  Synthetic Oligonucleotide
catcagatttagtaat

SEQ ID NO: 4713 - DNA, 16 bp, Artificial sequence
  Synthetic Oligonucleotide
gttattacatcagatt

SEQ ID NO: 4714 - DNA, 16 bp, Artificial sequence
  Synthetic Oligonucleotide
gcctagaatcaataaa

SEQ ID NO: 4715 - DNA, 16 bp, Artificial sequence
  Synthetic Oligonucleotide
aggaatgcctagaatc

SEQ ID NO: 4716 - DNA, 16 bp, Artificial sequence
  Synthetic Oligonucleotide
ttcagcaggaatgcct

SEQ ID NO: 4717 - DNA, 16 bp, Artificial sequence
  Synthetic Oligonucleotide
ttacctgatataacat

SEQ ID NO: 4718 - DNA, 16 bp, Artificial sequence
  Synthetic Oligonucleotide
caggttttacctgata

SEQ ID NO: 4719 - DNA, 16 bp, Artificial sequence
  Synthetic Oligonucleotide
cttagacaggttttac

SEQ ID NO: 4720 - DNA, 16 bp, Artificial sequence
  Synthetic Oligonucleotide
attctccttagacagg

SEQ ID NO: 4721 - DNA, 16 bp, Artificial sequence
  Synthetic Oligonucleotide
ctgtctattctcctta

SEQ ID NO: 4722 - DNA, 16 bp, Artificial sequence
  Synthetic Oligonucleotide
taactactgtctattc

SEQ ID NO: 4723 - DNA, 16 bp, Artificial sequence
  Synthetic Oligonucleotide
ttgaactaactactgt

SEQ ID NO: 4724 - DNA, 16 bp, Artificial sequence
  Synthetic Oligonucleotide
agtaagttgaactaac

SEQ ID NO: 4725 - DNA, 16 bp, Artificial sequence
  Synthetic Oligonucleotide
gtaatgagtaagttga

SEQ ID NO: 4726 - DNA, 16 bp, Artificial sequence
  Synthetic Oligonucleotide
taatcttcctaatacg

SEQ ID NO: 4727 - DNA, 16 bp, Artificial sequence
  Synthetic Oligonucleotide
accaggttaatcttcc

SEQ ID NO: 4728 - DNA, 16 bp, Artificial sequence
  Synthetic Oligonucleotide
atgataaccaggttaa

SEQ ID NO: 4729 - DNA, 16 bp, Artificial sequence
  Synthetic Oligonucleotide
cgaatactcatatata

SEQ ID NO: 4730 - DNA, 16 bp, Artificial sequence
  Synthetic Oligonucleotide
tttatacgaatactca

SEQ ID NO: 4731 - DNA, 16 bp, Artificial sequence
  Synthetic Oligonucleotide
attatatttatacgaa

SEQ ID NO: 4732 - DNA, 16 bp, Artificial sequence
  Synthetic Oligonucleotide
ggtaaaagtattatat

SEQ ID NO: 4733 - DNA, 16 bp, Artificial sequence
  Synthetic Oligonucleotide
gagaatattgagtaaa

SEQ ID NO: 4734 - DNA, 16 bp, Artificial sequence
  Synthetic Oligonucleotide
cagattattttagagg

SEQ ID NO: 4735 - DNA, 16 bp, Artificial sequence
  Synthetic Oligonucleotide
tcacttcagattattt

SEQ ID NO: 4736 - DNA, 16 bp, Artificial sequence
  Synthetic Oligonucleotide
taatagtcacttcaga

SEQ ID NO: 4737 - DNA, 16 bp, Artificial sequence
  Synthetic Oligonucleotide
tattgataatagtcac

SEQ ID NO: 4738 - DNA, 16 bp, Artificial sequence
  Synthetic Oligonucleotide
tactatttgtaatcaa

SEQ ID NO: 4739 - DNA, 16 bp, Artificial sequence
  Synthetic Oligonucleotide
cttgcttattttacta

SEQ ID NO: 4740 - DNA, 16 bp, Artificial sequence
  Synthetic Oligonucleotide
catctgttattttatc

SEQ ID NO: 4741 - DNA, 16 bp, Artificial sequence
  Synthetic Oligonucleotide
atgtgctttttggatt

SEQ ID NO: 4742 - DNA, 16 bp, Artificial sequence
  Synthetic Oligonucleotide
ggatttttgtatgtgc

SEQ ID NO: 4743 - DNA, 16 bp, Artificial sequence
  Synthetic Oligonucleotide
catcattcatggattt

SEQ ID NO: 4744 - DNA, 16 bp, Artificial sequence
  Synthetic Oligonucleotide
cttagacatcattcat

SEQ ID NO: 4745 - DNA, 16 bp, Artificial sequence
  Synthetic Oligonucleotide
tgagtacttagacatc

SEQ ID NO: 4746 - DNA, 16 bp, Artificial sequence
  Synthetic Oligonucleotide
tataagtgagtactta

SEQ ID NO: 4747 - DNA, 16 bp, Artificial sequence
  Synthetic Oligonucleotide
ctactttataagtgag

SEQ ID NO: 4748 - DNA, 16 bp, Artificial sequence
  Synthetic Oligonucleotide
tgaatgtcttctactt

SEQ ID NO: 4749 - DNA, 16 bp, Artificial sequence
  Synthetic Oligonucleotide
tataataatgaatgtc

SEQ ID NO: 4750 - DNA, 16 bp, Artificial sequence
  Synthetic Oligonucleotide
gtactgagcatttaaa

SEQ ID NO: 4751 - DNA, 16 bp, Artificial sequence
  Synthetic Oligonucleotide
caaatagtactgagca

SEQ ID NO: 4752 - DNA, 16 bp, Artificial sequence
  Synthetic Oligonucleotide
aatggtcaaatagtac

SEQ ID NO: 4753 - DNA, 16 bp, Artificial sequence
  Synthetic Oligonucleotide
gtagtttgaatacaaa

SEQ ID NO: 4754 - DNA, 16 bp, Artificial sequence
  Synthetic Oligonucleotide
tcactggtagtttgaa

SEQ ID NO: 4755 - DNA, 16 bp, Artificial sequence
  Synthetic Oligonucleotide
taggtagggctttcac

SEQ ID NO: 4756 - DNA, 16 bp, Artificial sequence
  Synthetic Oligonucleotide
accttctaggtagggc

SEQ ID NO: 4757 - DNA, 16 bp, Artificial sequence
  Synthetic Oligonucleotide
gagtataccttctagg

SEQ ID NO: 4758 - DNA, 16 bp, Artificial sequence
  Synthetic Oligonucleotide
atcactgagtatacct

SEQ ID NO: 4759 - DNA, 16 bp, Artificial sequence
  Synthetic Oligonucleotide
aaacttatcactgagt

SEQ ID NO: 4760 - DNA, 16 bp, Artificial sequence
  Synthetic Oligonucleotide
gctacaaaacttatca

SEQ ID NO: 4761 - DNA, 16 bp, Artificial sequence
  Synthetic Oligonucleotide
tttggagctacaaaac

SEQ ID NO: 4762 - DNA, 16 bp, Artificial sequence
  Synthetic Oligonucleotide
agaagatttggagcta

SEQ ID NO: 4763 - DNA, 16 bp, Artificial sequence
  Synthetic Oligonucleotide
actattagaagatttg

SEQ ID NO: 4764 - DNA, 16 bp, Artificial sequence
  Synthetic Oligonucleotide
acactcactattagaa

SEQ ID NO: 4765 - DNA, 16 bp, Artificial sequence
  Synthetic Oligonucleotide
agccttttattttggg

SEQ ID NO: 4766 - DNA, 16 bp, Artificial sequence
  Synthetic Oligonucleotide
cctgtcagccttttat

SEQ ID NO: 4767 - DNA, 16 bp, Artificial sequence
  Synthetic Oligonucleotide
gacttacctgtcagcc

SEQ ID NO: 4768 - DNA, 16 bp, Artificial sequence
  Synthetic Oligonucleotide
attctcgacttacctg

SEQ ID NO: 4769 - DNA, 16 bp, Artificial sequence
  Synthetic Oligonucleotide
gtgagtattctcgact

SEQ ID NO: 4770 - DNA, 16 bp, Artificial sequence
  Synthetic Oligonucleotide
aattaagtgagtattc

SEQ ID NO: 4771 - DNA, 16 bp, Artificial sequence
  Synthetic Oligonucleotide
taccagaattaagtga

SEQ ID NO: 4772 - DNA, 16 bp, Artificial sequence
  Synthetic Oligonucleotide
gctttcttaccagaat

SEQ ID NO: 4773 - DNA, 16 bp, Artificial sequence
  Synthetic Oligonucleotide
tgggttgctttcttac

SEQ ID NO: 4774 - DNA, 16 bp, Artificial sequence
  Synthetic Oligonucleotide
tacaagtacaaatggg

SEQ ID NO: 4775 - DNA, 16 bp, Artificial sequence
  Synthetic Oligonucleotide
ggtaaatacaagtaca

SEQ ID NO: 4776 - DNA, 16 bp, Artificial sequence
  Synthetic Oligonucleotide
attgctggtaaataca

SEQ ID NO: 4777 - DNA, 16 bp, Artificial sequence
  Synthetic Oligonucleotide
ttaaggattgctggta

SEQ ID NO: 4778 - DNA, 16 bp, Artificial sequence
  Synthetic Oligonucleotide
gcttcattttaaggat

SEQ ID NO: 4779 - DNA, 16 bp, Artificial sequence
  Synthetic Oligonucleotide
gtaggaagcttcattt

SEQ ID NO: 4780 - DNA, 16 bp, Artificial sequence
  Synthetic Oligonucleotide
gagttagtaggaagct

SEQ ID NO: 4781 - DNA, 16 bp, Artificial sequence
  Synthetic Oligonucleotide
gctattgagttagtag

SEQ ID NO: 4782 - DNA, 16 bp, Artificial sequence
  Synthetic Oligonucleotide
cttattgctattgagt

SEQ ID NO: 4783 - DNA, 16 bp, Artificial sequence
  Synthetic Oligonucleotide
tattgtcttattgcta

SEQ ID NO: 4784 - DNA, 16 bp, Artificial sequence
  Synthetic Oligonucleotide
attcactattgtctta

SEQ ID NO: 4785 - DNA, 16 bp, Artificial sequence
  Synthetic Oligonucleotide
atcacaatccttttta

SEQ ID NO: 4786 - DNA, 16 bp, Artificial sequence
  Synthetic Oligonucleotide
ttcttcatcacaatcc

SEQ ID NO: 4787 - DNA, 16 bp, Artificial sequence
  Synthetic Oligonucleotide
agattgttcttcatca

SEQ ID NO: 4788 - DNA, 16 bp, Artificial sequence
  Synthetic Oligonucleotide
tataaatagattgttc

SEQ ID NO: 4789 - DNA, 16 bp, Artificial sequence
  Synthetic Oligonucleotide
ggttcttaataacttt

SEQ ID NO: 4790 - DNA, 16 bp, Artificial sequence
  Synthetic Oligonucleotide
aagcatggttcttaat

SEQ ID NO: 4791 - DNA, 16 bp, Artificial sequence
  Synthetic Oligonucleotide
ctttgtagaaaaagac

SEQ ID NO: 4792 - DNA, 16 bp, Artificial sequence
  Synthetic Oligonucleotide
tatgctttctttgtag

SEQ ID NO: 4793 - DNA, 16 bp, Artificial sequence
  Synthetic Oligonucleotide
cttaatgtatgctttc

SEQ ID NO: 4794 - DNA, 16 bp, Artificial sequence
  Synthetic Oligonucleotide
gtatttgcttaatgta

SEQ ID NO: 4795 - DNA, 16 bp, Artificial sequence
  Synthetic Oligonucleotide
cctttggtatttgctt

SEQ ID NO: 4796 - DNA, 16 bp, Artificial sequence
  Synthetic Oligonucleotide
acctggcctttggtat

SEQ ID NO: 4797 - DNA, 16 bp, Artificial sequence
  Synthetic Oligonucleotide
atgtaaacctggcctt

SEQ ID NO: 4798 - DNA, 16 bp, Artificial sequence
  Synthetic Oligonucleotide
cttcaaatgtaaacct

SEQ ID NO: 4799 - DNA, 16 bp, Artificial sequence
  Synthetic Oligonucleotide
gtaataataatgtcac

SEQ ID NO: 4800 - DNA, 16 bp, Artificial sequence
  Synthetic Oligonucleotide
agacttgagtaataat

SEQ ID NO: 4801 - DNA, 16 bp, Artificial sequence
  Synthetic Oligonucleotide
tcctagagacttgagt

SEQ ID NO: 4802 - DNA, 16 bp, Artificial sequence
  Synthetic Oligonucleotide
aagtattcctagagac

SEQ ID NO: 4803 - DNA, 16 bp, Artificial sequence
  Synthetic Oligonucleotide
tgtgttaagtattcct

SEQ ID NO: 4804 - DNA, 16 bp, Artificial sequence
  Synthetic Oligonucleotide
aagagatgtgttaagt

SEQ ID NO: 4805 - DNA, 16 bp, Artificial sequence
  Synthetic Oligonucleotide
ccatatacagtcaaga

SEQ ID NO: 4806 - DNA, 16 bp, Artificial sequence
  Synthetic Oligonucleotide
taacatccatatacag

SEQ ID NO: 4807 - DNA, 16 bp, Artificial sequence
  Synthetic Oligonucleotide
ctatttattaacatcc

SEQ ID NO: 4808 - DNA, 16 bp, Artificial sequence
  Synthetic Oligonucleotide
tgtcagctatttatta

SEQ ID NO: 4809 - DNA, 16 bp, Artificial sequence
  Synthetic Oligonucleotide
ctttactgtcagctat

SEQ ID NO: 4810 - DNA, 16 bp, Artificial sequence
  Synthetic Oligonucleotide
gataaactttactgtc

SEQ ID NO: 4811 - DNA, 16 bp, Artificial sequence
  Synthetic Oligonucleotide
ctttatatggataaac

SEQ ID NO: 4812 - DNA, 16 bp, Artificial sequence
  Synthetic Oligonucleotide
gcaagtctttatatgg

SEQ ID NO: 4813 - DNA, 20 bp, Artificial sequence
  Synthetic Oligonucleotide
ctgggtattactcttttcta

SEQ ID NO: 4814 - DNA, 20 bp, Artificial sequence
  Synthetic Oligonucleotide
cttgctgggtattactcttt

SEQ ID NO: 4815 - DNA, 20 bp, Artificial sequence
  Synthetic Oligonucleotide
tgcttgctgggtattactct

SEQ ID NO: 4816 - DNA, 20 bp, Artificial sequence
  Synthetic Oligonucleotide
catgaatgatatttcctagg

SEQ ID NO: 4817 - DNA, 20 bp, Artificial sequence
  Synthetic Oligonucleotide
ggcatgaatgatatttccta

SEQ ID NO: 4818 - DNA, 20 bp, Artificial sequence
  Synthetic Oligonucleotide
ctggcatgaatgatatttcc

SEQ ID NO: 4819 - DNA, 20 bp, Artificial sequence
  Synthetic Oligonucleotide
tgctggcatgaatgatattt

SEQ ID NO: 4820 - DNA, 20 bp, Artificial sequence
  Synthetic Oligonucleotide
aagtccatatttgtatttct

SEQ ID NO: 4821 - DNA, 20 bp, Artificial sequence
  Synthetic Oligonucleotide
gcaaatgtagcattttttca

SEQ ID NO: 4822 - DNA, 20 bp, Artificial sequence
  Synthetic Oligonucleotide
ggcaaatgtagcattttttc

SEQ ID NO: 4823 - DNA, 20 bp, Artificial sequence
  Synthetic Oligonucleotide
ctggtccttttaacttccaa

SEQ ID NO: 4824 - DNA, 20 bp, Artificial sequence
  Synthetic Oligonucleotide
cctggtccttttaacttcca

SEQ ID NO: 4825 - DNA, 20 bp, Artificial sequence
  Synthetic Oligonucleotide
ttcctggtccttttaacttc

SEQ ID NO: 4826 - DNA, 20 bp, Artificial sequence
  Synthetic Oligonucleotide
tgcttaatgtatgctttctt

SEQ ID NO: 4827 - DNA, 20 bp, Artificial sequence
  Synthetic Oligonucleotide
ccgtaagtttatcttccttt

SEQ ID NO: 4828 - DNA, 20 bp, Artificial sequence
  Synthetic Oligonucleotide
ccccgtaagtttatcttcct

SEQ ID NO: 4829 - DNA, 20 bp, Artificial sequence
  Synthetic Oligonucleotide
cacaaatatgttcattctta

SEQ ID NO: 4830 - DNA, 20 bp, Artificial sequence
  Synthetic Oligonucleotide
aaactttaactcgatgccac

SEQ ID NO: 4831 - DNA, 20 bp, Artificial sequence
  Synthetic Oligonucleotide
ataaactttaactcgatgcc

SEQ ID NO: 4832 - DNA, 20 bp, Artificial sequence
  Synthetic Oligonucleotide
atgcttgtcaggctgtttaa

SEQ ID NO: 4833 - DNA, 20 bp, Artificial sequence
  Synthetic Oligonucleotide
gtcaccatataacttgggca

SEQ ID NO: 4834 - DNA, 20 bp, Artificial sequence
  Synthetic Oligonucleotide
aggtcaccatataacttggg

SEQ ID NO: 4835 - DNA, 17 bp, Artificial sequence
  Synthetic Oligonucleotide
gctgggtattactcttt

SEQ ID NO: 4836 - DNA, 17 bp, Artificial sequence
  Synthetic Oligonucleotide
gcatgaatgatatttcc

SEQ ID NO: 4837 - DNA, 17 bp, Artificial sequence
  Synthetic Oligonucleotide
ggcaaatgtagcatttt

SEQ ID NO: 4838 - DNA, 17 bp, Artificial sequence
  Synthetic Oligonucleotide
ctggtccttttaacttc

SEQ ID NO: 4839 - DNA, 17 bp, Artificial sequence
  Synthetic Oligonucleotide
gtaagtttatcttcctt

SEQ ID NO: 4840 - DNA, 17 bp, Artificial sequence
  Synthetic Oligonucleotide
actttaactcgatgcca

SEQ ID NO: 4841 - DNA, 17 bp, Artificial sequence
  Synthetic Oligonucleotide
aactttaactcgatgcc

SEQ ID NO: 4842 - DNA, 17 bp, Artificial sequence
  Synthetic Oligonucleotide
aaactttaactcgatgc

SEQ ID NO: 4843 - DNA, 17 bp, Artificial sequence
  Synthetic Oligonucleotide
caccatataacttgggc

SEQ ID NO: 4844 - DNA, 17 bp, Artificial sequence
  Synthetic Oligonucleotide
tcaccatataacttggg

SEQ ID NO: 4845 - DNA, 17 bp, Artificial sequence
  Synthetic Oligonucleotide
gtcaccatataacttgg

SEQ ID NO: 4846 - DNA, 20 bp, Artificial sequence
  Synthetic Oligonucleotide
cttgattttggctctggaga

SEQ ID NO: 4847 - DNA, 17 bp, Artificial sequence
  Synthetic Oligonucleotide
tgattttggctctggag

SEQ ID NO: 4848 - DNA, 17 bp, Artificial sequence
  Synthetic Oligonucleotide
actggtttgcagcgata

SEQ ID NO: 4849 - DNA, 20 bp, Artificial sequence
  Synthetic Oligonucleotide
tttcactggtttgcagcgat

SEQ ID NO: 4850 - DNA, 17 bp, Artificial sequence
  Synthetic Oligonucleotide
cactggtttgcagcgat

SEQ ID NO: 4851 - DNA, 17 bp, Artificial sequence
  Synthetic Oligonucleotide
tcactggtttgcagcga

SEQ ID NO: 4852 - DNA, 17 bp, Artificial sequence
  Synthetic Oligonucleotide
ttcttggtgctcttggc

SEQ ID NO: 4853 - DNA, 17 bp, Artificial sequence
  Synthetic Oligonucleotide
gttcttggtgctcttgg

SEQ ID NO: 4854 - DNA, 20 bp, Artificial sequence
  Synthetic Oligonucleotide
ttgtctttccagtcttccaa

SEQ ID NO: 4855 - DNA, 20 bp, Artificial sequence
  Synthetic Oligonucleotide
tgttgtctttccagtcttcc

SEQ ID NO: 4856 - DNA, 17 bp, Artificial sequence
  Synthetic Oligonucleotide
cattgccagtaatcgca

SEQ ID NO: 4857 - DNA, 17 bp, Artificial sequence
  Synthetic Oligonucleotide
acattgccagtaatcgc

SEQ ID NO: 4858 - DNA, 17 bp, Artificial sequence
  Synthetic Oligonucleotide
gacattgccagtaatcg

SEQ ID NO: 4859 - DNA, 20 bp, Artificial sequence
  Synthetic Oligonucleotide
ctttgtgatcccaagtagaa

SEQ ID NO: 4860 - DNA, 17 bp, Artificial sequence
  Synthetic Oligonucleotide
ttgtgatcccaagtaga

SEQ ID NO: 4861 - DNA, 20 bp, Artificial sequence
  Synthetic Oligonucleotide
tgctttgtgatcccaagtag

SEQ ID NO: 4862 - DNA, 17 bp, Artificial sequence
  Synthetic Oligonucleotide
tttgtgatcccaagtag

SEQ ID NO: 4863 - DNA, 17 bp, Artificial sequence
  Synthetic Oligonucleotide
ctttgtgatcccaagta

SEQ ID NO: 4864 - DNA, 17 bp, Artificial sequence
  Synthetic Oligonucleotide
cacactcatcatgccac

SEQ ID NO: 4865 - DNA, 20 bp, Artificial sequence
  Synthetic Oligonucleotide
gttgttttctccacactcat

SEQ ID NO: 4866 - DNA, 17 bp, Artificial sequence
  Synthetic Oligonucleotide
agattttgctcttggtt

SEQ ID NO: 4867 - DNA, 17 bp, Artificial sequence
  Synthetic Oligonucleotide
tagattttgctcttggt

SEQ ID NO: 4868 - DNA, 17 bp, Artificial sequence
  Synthetic Oligonucleotide
ttagattttgctcttgg

SEQ ID NO: 4869 - DNA, 17 bp, Artificial sequence
  Synthetic Oligonucleotide
cttagattttgctcttg

SEQ ID NO: 4870 - DNA, 17 bp, Artificial sequence
  Synthetic Oligonucleotide
agattattagaccacat

SEQ ID NO: 4871 - DNA, 17 bp, Artificial sequence
  Synthetic Oligonucleotide
cagattattagaccaca

SEQ ID NO: 4872 - DNA, 17 bp, Artificial sequence
  Synthetic Oligonucleotide
accagattattagacca

SEQ ID NO: 4873 - DNA, 17 bp, Artificial sequence
  Synthetic Oligonucleotide
acatactctgtgctgac

SEQ ID NO: 4874 - DNA, 20 bp, Artificial sequence
  Synthetic Oligonucleotide
ttacacatactctgtgctga

SEQ ID NO: 4875 - DNA, 17 bp, Artificial sequence
  Synthetic Oligonucleotide
cttagtagtcatctcca

SEQ ID NO: 4876 - DNA, 17 bp, Artificial sequence
  Synthetic Oligonucleotide
acttagtagtcatctcc

SEQ ID NO: 4877 - DNA, 17 bp, Artificial sequence
  Synthetic Oligonucleotide
gacttagtagtcatctc

SEQ ID NO: 4878 - DNA, 20 bp, Artificial sequence
  Synthetic Oligonucleotide
agcttcttgtccagctttat

SEQ ID NO: 4879 - DNA, 21 bp, Artificial sequence
  Synthetic Oligonucleotide
agcttcttgtccagctttata

SEQ ID NO: 4880 - DNA, 14 bp, Artificial sequence
  Synthetic Oligonucleotide
tcagtcatgacttc

SEQ ID NO: 4881 - DNA, 15 bp, Artificial sequence
  Synthetic Oligonucleotide
tcagtcatgacttca

SEQ ID NO: 4882 - DNA, 20 bp, Artificial sequence
  Synthetic Oligonucleotide
gctgattagagagaggtccc

SEQ ID NO: 4883 - DNA, 20 bp, Artificial sequence
  Synthetic Oligonucleotide
tcccatttcaggagacctgg

SEQ ID NO: 4884 - DNA, 15 bp, Artificial sequence
  Synthetic Oligonucleotide
atcagtcatgacttc

SEQ ID NO: 4885 - DNA, 20 bp, Artificial sequence
  Synthetic Oligonucleotide
cggtgcaaggcttaggaatt

SEQ ID NO: 4886 - DNA, 20 bp, Artificial sequence
  Synthetic Oligonucleotide
gcttcagtcatgacttcctt

SEQ ID NO: 4887 - DNA, 21 bp, Artificial sequence
  Synthetic Oligonucleotide
gcttcagtcatgacttcctta

SEQ ID NO: 4888 - DNA, 21 bp, Artificial sequence
  Synthetic Oligonucleotide
agcttcagtcatgacttcctt

SEQ ID NO: 4889 - DNA, 20 bp, Artificial sequence
  Synthetic Oligonucleotide
tggtaatccactttcagagg

SEQ ID NO: 4890 - DNA, 21 bp, Artificial sequence
  Synthetic Oligonucleotide
tggtaatccactttcagagga

SEQ ID NO: 4891 - DNA, 21 bp, Artificial sequence
  Synthetic Oligonucleotide
tgcttcagtcatgacttcctt

SEQ ID NO: 4892 - DNA, 20 bp, Artificial sequence
  Synthetic Oligonucleotide
cactgatttttgcccaggat

SEQ ID NO: 4893 - DNA, 21 bp, Artificial sequence
  Synthetic Oligonucleotide
cactgatttttgcccaggata

SEQ ID NO: 4894 - DNA, 21 bp, Artificial sequence
  Synthetic Oligonucleotide
aagcttcttgtccagctttat

SEQ ID NO: 4895 - DNA, 20 bp, Artificial sequence
  Synthetic Oligonucleotide
acccaattcagaaggaagga

SEQ ID NO: 4896 - DNA, 21 bp, Artificial sequence
  Synthetic Oligonucleotide
acccaattcagaaggaaggaa

SEQ ID NO: 4897 - DNA, 21 bp, Artificial sequence
  Synthetic Oligonucleotide
aacccaattcagaaggaagga

SEQ ID NO: 4898 - DNA, 21 bp, Artificial sequence
  Synthetic Oligonucleotide
atggtaatccactttcagagg

SEQ ID NO: 4899 - DNA, 20 bp, Artificial sequence
  Synthetic Oligonucleotide
tcttggttacatgaaatccc

SEQ ID NO: 4900 - DNA, 21 bp, Artificial sequence
  Synthetic Oligonucleotide
tcttggttacatgaaatccca

SEQ ID NO: 4901 - DNA, 20 bp, Artificial sequence
  Synthetic Oligonucleotide
attcactttcataatgctgg

SEQ ID NO: 4902 - DNA, 21 bp, Artificial sequence
  Synthetic Oligonucleotide
attcactttcataatgctgga

SEQ ID NO: 4903 - DNA, 20 bp, Artificial sequence
  Synthetic Oligonucleotide
tgctccgttggtgcttgttc

SEQ ID NO: 4904 - DNA, 21 bp, Artificial sequence
  Synthetic Oligonucleotide
atcttggttacatgaaatccc

SEQ ID NO: 4905 - DNA, 20 bp, Artificial sequence
  Synthetic Oligonucleotide
atgcatggtgatgcttctga

SEQ ID NO: 4906 - DNA, 20 bp, Artificial sequence
  Synthetic Oligonucleotide
cagctttattagggacagca

SEQ ID NO: 4907 - DNA, 21 bp, Artificial sequence
  Synthetic Oligonucleotide
cagctttattagggacagcaa

SEQ ID NO: 4908 - DNA, 21 bp, Artificial sequence
  Synthetic Oligonucleotide
acagctttattagggacagca

SEQ ID NO: 4909 - DNA, 16 bp, Artificial sequence
  Synthetic Oligonucleotide
ttcagtcatgacttcc

SEQ ID NO: 4910 - DNA, 20 bp, Artificial sequence
  Synthetic Oligonucleotide
  misc_feature (1)..(5): Bases at these positions are RNA
  misc_feature (16)..(20): Bases at these positions are RNA
gcuucagtcatgactuccuu

SEQ ID NO: 4911 - DNA, 21 bp, Artificial sequence
  Synthetic Oligonucleotide
tgctccgttggtgcttgttca

SEQ ID NO: 4912 - DNA, 21 bp, Artificial sequence
  Synthetic Oligonucleotide
ggacattgccagtaatcgcaa

SEQ ID NO: 4913 - DNA, 21 bp, Artificial sequence
  Synthetic Oligonucleotide
aggacattgccagtaatcgca

SEQ ID NO: 4914 - DNA, 20 bp, Artificial sequence
  Synthetic Oligonucleotide
gacatgttcttcacctcctc

The invention claimed is:

1. A compound comprising a modified oligonucleotide and a conjugate group, wherein the modified oligonucleotide consists of 20 contiguous nucleobases complementary to an equal length portion of nucleobases 1140 to 1159 of SEQ ID NO: 1, wherein the nucleobase sequence of the modified oligonucleotide is at least 80% complementary to SEQ ID NO: 1; and wherein the conjugate group comprises:

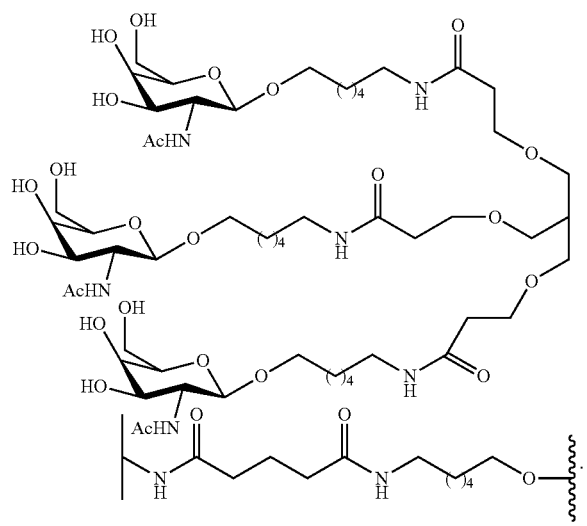

2. The compound of claim 1, wherein the modified oligonucleotide comprises at least one modified sugar.

3. The compound of claim 2, wherein at least one modified sugar is a bicyclic sugar.

4. The compound of claim 2, wherein at least one modified sugar comprises a 2'-O-methoxyethyl, a constrained ethyl, a 3'-fluoro-HNA or a 4'-$(CH_2)_n$—O-2' bridge, wherein n is 1 or 2.

5. The compound of claim 2, wherein at least one modified sugar is 2'-O-methoxyethyl.

6. The compound of claim 1, wherein the modified oligonucleotide comprises at least one modified nucleobase.

7. The compound of claim 6, wherein the modified nucleobase is a 5-methylcytosine.

8. The compound of claim 1, wherein the conjugate group is linked to the modified oligonucleotide at the 5' end of the modified oligonucleotide.

9. The compound of claim 1, wherein the conjugate group is linked to the modified oligonucleotide at the 3' end of the modified oligonucleotide.

10. The compound of claim 1, wherein each internucleoside linkage of the modified oligonucleotide is selected from a phosphodiester internucleoside linkage and a phosphorothioate internucleoside linkage.

11. The compound of claim 10, wherein the modified oligonucleotide comprises at least 5 phosphodiester internucleoside linkages.

12. The compound of claim 10, wherein the modified oligonucleotide comprises at least 2 phosphorothioate internucleoside linkages.

13. The compound of claim 1, wherein the modified oligonucleotide is single stranded.

14. The compound of claim 1, wherein the modified oligonucleotide is double stranded.

15. The compound of claim 1, wherein the modified oligonucleotide comprises:

a gap segment consisting of linked deoxynucleosides;
a 5' wing segment consisting of linked nucleosides;
a 3' wing segment consisting of linked nucleosides;
wherein the gap segment is positioned between the 5' wing segment and the 3' wing segment and
wherein each nucleoside of each wing segment comprises a modified sugar.

16. The compound of claim 15, wherein each internucleoside linkage in the gap segment of the modified oligonucleotide is a phosphorothioate linkage.

17. The compound of claim 16, wherein the modified oligonucleotide further comprises at least one phosphorothioate internucleoside linkage in each wing segment.

18. The compound of claim 1, wherein the modified oligonucleotide comprises:

a gap segment consisting of ten linked deoxynucleosides;
a 5' wing segment consisting of five linked nucleosides;
a 3' wing segment consisting of five linked nucleosides;
wherein the gap segment is positioned between the 5' wing segment and the 3' wing segment, wherein each nucleoside of each wing segment comprises a 2'-O-methoxyethyl sugar, and wherein each cytosine residue is a 5-methylcytosine.

19. The compound of claim 18, wherein each internucleoside linkage in the gap segment of the modified oligonucleotide is a phosphorothioate linkage.

20. The compound of claim 19, wherein the modified oligonucleotide further comprises at least one phosphorothioate internucleoside linkage in each wing segment.

21. The compound of claim 1, wherein the modified oligonucleotide comprises the nucleobase sequence of SEQ ID NO: 77, and wherein the modified oligonucleotide comprises:
a gap segment consisting of ten linked deoxynucleosides;
a 5' wing segment consisting of five linked nucleosides;
a 3' wing segment consisting of five linked nucleosides;
wherein the gap segment is positioned between the 5' wing segment and the 3' wing segment, wherein each nucleoside of each wing segment comprises a 2'-O-methoxyethyl sugar, wherein each internucleoside linkage in the gap segment is a phosphorothioate linkage and wherein each cytosine residue is a 5-methylcytosine.

22. The compound of claim 21, wherein the modified oligonucleotide further comprises at least one phosphorothioate internucleoside linkage in each wing segment.

23. The compound of claim 21, wherein the internucleoside linkages are phosphorothioate linkages between nucleosides 1-2, nucleosides 6-16 and nucleosides 18-20 of the modified oligonucleotide, wherein nucleosides 1-20 are positioned 5' to 3'.

24. The compound of claim 21, wherein the $2^{nd}$, $3^{rd}$, $4^{th}$ and $5^{th}$ internucleoside linkage from the 5'-end is a phosphodiester internucleoside linkage, wherein the $3^{rd}$ and $4^{th}$ internucleoside linkage from the 3'-end is a phosphodiester internucleoside linkage, and wherein each remaining internucleoside linkage is a phosphorothioate internucleoside linkage.

25. The compound of claim 1, having the formula:

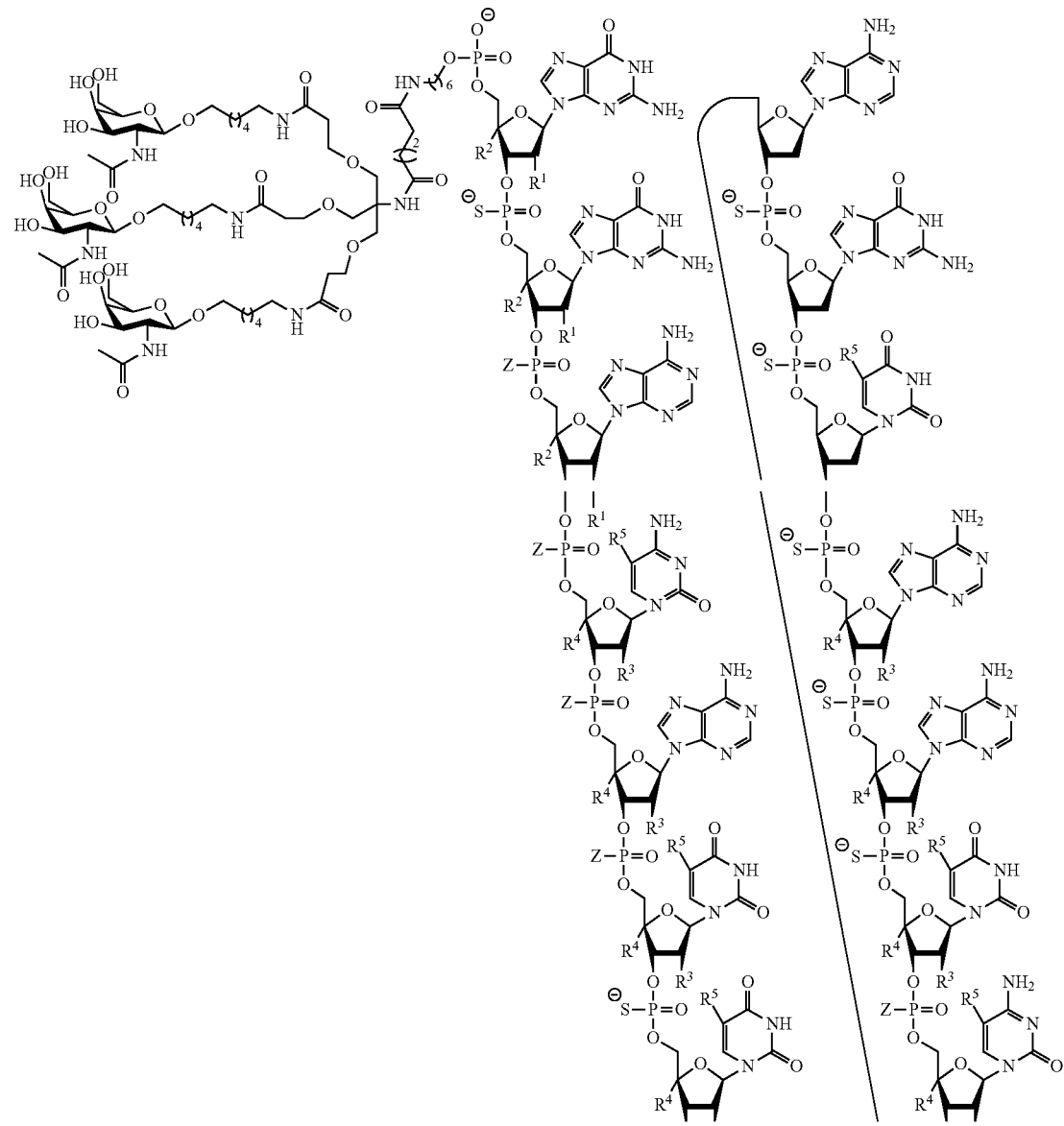

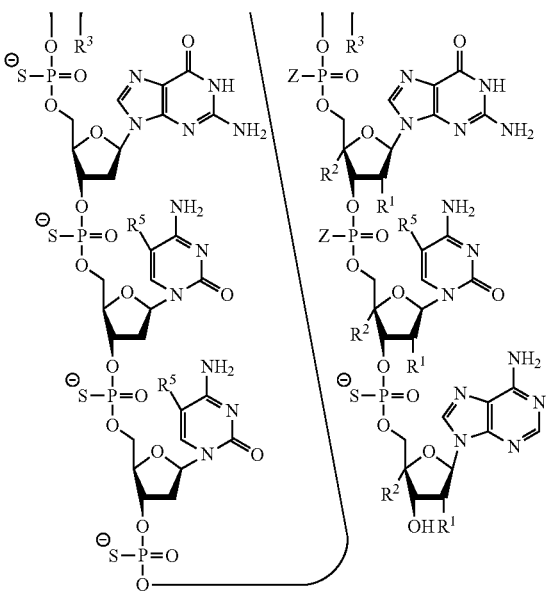

wherein either R¹ is —OCH₂CH₂OCH₃ (MOE) and R² is H; or R¹ and R² together form a bridge, wherein R¹ is —O— and R² is —CH₂—, —CH(CH₃)—, or —CH₂CH₂—, and R¹ and R² are directly connected such that the resulting bridge is selected from: —O—CH₂—, —O—CH(CH₃)—, and —O—CH₂CH₂—;

and for each pair of R³ and R⁴ on the same ring, independently for each ring: either R³ is selected from H and —OCH₂CH₂OCH₃ and R⁴ is H; or R³ and R⁴ together form a bridge, wherein R³ is —O—, and R⁴ is —CH₂—, —CH(CH₃)—, or —CH₂CH₂— and R³ and R⁴ are directly connected such that the resulting bridge is selected from: —O—CH₂—, —O—CH(CH₃)—, and —O—CH₂CH₂—;

and R⁵ is selected from H and —CH₃;

and Z is selected from S⁻ and O⁻.

26. The compound of claim 1, having the formula:

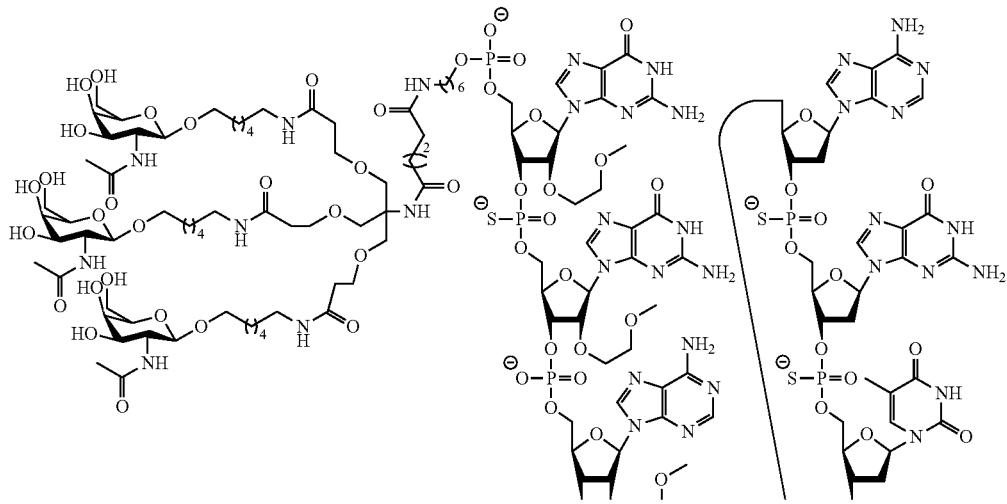

-continued
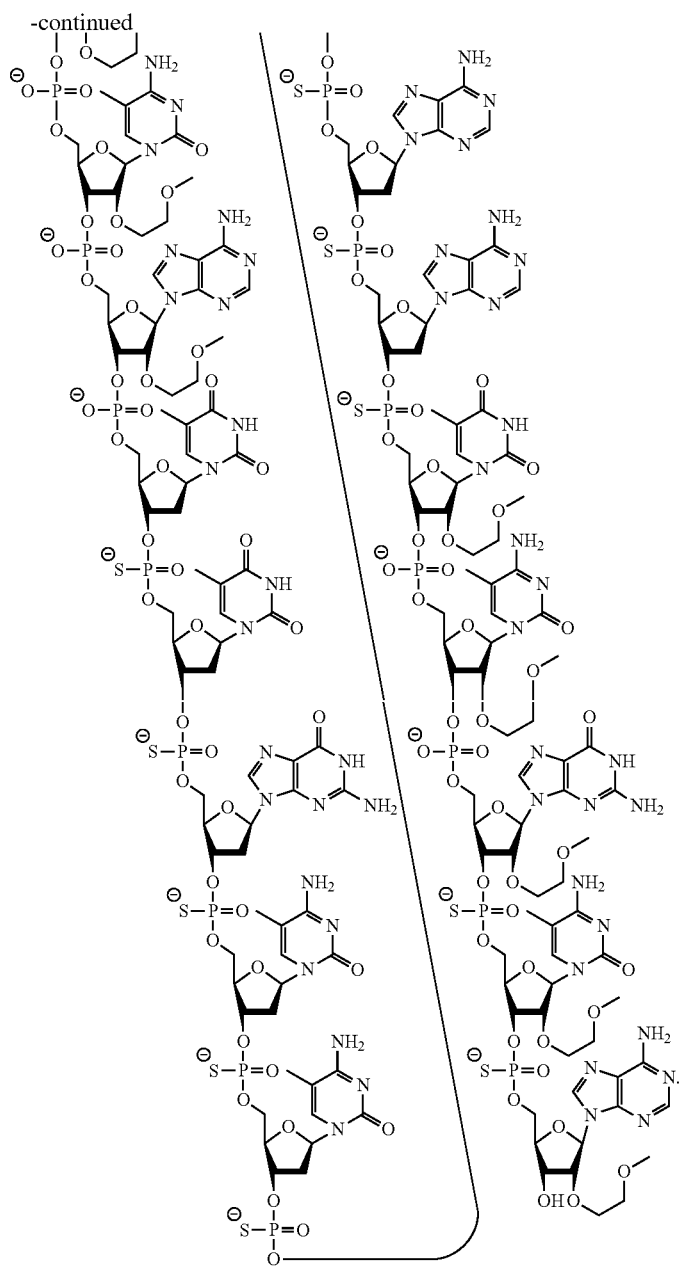
27. A composition comprising the compound of claim 1, or a salt thereof, and a pharmaceutically acceptable carrier or diluent.
28. A composition comprising the compound of claim 26, or a salt thereof, and a pharmaceutically acceptable carrier or diluent.
* * * * *